United States Patent 10,981,992 (BISPECIFIC IMMUNOMODULATORY ANTIBODIES THAT BIND COSTIMULATORY AND CHECKPOINT RECEPTORS) - sequence listing, part 3

SEQ ID NO: 27446 - protein, 452 aa, Artificial Sequence; identical to SEQ ID NO: 26302
  Description of Artificial Sequence: Synthetic polypeptide
  XENP021820 GSK_314.8[ICOS]_H0L0_IgG1_PVA_/S267K Heavy Chain

SEQ ID NO: 27447 - protein, 123 aa, Artificial Sequence; identical to SEQ ID NO: 26303
  Description of Artificial Sequence: Synthetic polypeptide
  VH of XENP021820

SEQ ID NO: 27448 - protein, 5 aa, Artificial Sequence
  Description of Artificial Sequence: Synthetic peptide
  XENP021820 vhCDR1
TYWMH

SEQ ID NO: 27449 - protein, 17 aa, Artificial Sequence
  Description of Artificial Sequence: Synthetic peptide
  XENP021820 vhCDR2
EIDPSDSYVNYNQNFKG

SEQ ID NO: 27450 - protein, 14 aa, Artificial Sequence
  Description of Artificial Sequence: Synthetic peptide
  XENP021820 vhCDR3
SPDYYGTSLAWFDY

SEQ ID NO: 27451 - protein, 219 aa, Artificial Sequence; identical to SEQ ID NO: 26307
  Description of Artificial Sequence: Synthetic polypeptide
  XENP021820 GSK_314.8[ICOS]_H0L0_IgG1_PVA_/S267K Light Chain

SEQ ID NO: 27452 - protein, 112 aa, Artificial Sequence; identical to SEQ ID NO: 26308
  Description of Artificial Sequence: Synthetic polypeptide
  VL of XENP021820

SEQ ID NO: 27453 - protein, 16 aa, Artificial Sequence
  Description of Artificial Sequence: Synthetic peptide
  XENP021820 vlCDR1
RSSKSPLHSNGNIYLY

SEQ ID NO: 27454 - protein, 7 aa, Artificial Sequence
  Description of Artificial Sequence: Synthetic peptide
  XENP021820 vlCDR2
RMSNLAS

SEQ ID NO: 27455 - protein, 9 aa, Artificial Sequence
  Description of Artificial Sequence: Synthetic peptide
  XENP021820 vlCDR3
MQHLEYPYT

SEQ ID NO: 27456 - protein, 453 aa, Artificial Sequence; identical to SEQ ID NO: 26312
  Description of Artificial Sequence: Synthetic polypeptide
  XENP021821 GSK_88.2[ICOS]_H0L0_IgG1_PVA_/S267K Heavy Chain

SEQ ID NO: 27457 - protein, 124 aa, Artificial Sequence; identical to SEQ ID NO: 26313
  Description of Artificial Sequence: Synthetic polypeptide
  VH of XENP021821

SEQ ID NO: 27458 - protein, 5 aa, Artificial Sequence
  Description of Artificial Sequence: Synthetic peptide
  XENP021821 vhCDR1
SYWIN

SEQ ID NO: 27459 - protein, 17 aa, Artificial Sequence
  Description of Artificial Sequence: Synthetic peptide
  XENP021821 vhCDR2
NIYPSDSYTNYNQMFKD

SEQ ID NO: 27460 - protein, 15 aa, Artificial Sequence
  Description of Artificial Sequence: Synthetic peptide
  XENP021821 vhCDR3
WNLSYYFDNNYYLDY

SEQ ID NO: 27461 - protein, 219 aa, Artificial Sequence; identical to SEQ ID NO: 26317
  Description of Artificial Sequence: Synthetic polypeptide
  XENP021821 GSK_88.2[ICOS]_H0L0_IgG1_PVA_/S267K Light Chain

SEQ ID NO: 27462 - protein, 112 aa, Artificial Sequence; identical to SEQ ID NO: 26318
  Description of Artificial Sequence: Synthetic polypeptide
  VL of XENP021821

SEQ ID NO: 27463 - protein, 16 aa, Artificial Sequence
  Description of Artificial Sequence: Synthetic peptide
  XENP021821 vlCDR1
RSSKSLLHSNGNTYLY

SEQ ID NO: 27464 - protein, 7 aa, Artificial Sequence
  Description of Artificial Sequence: Synthetic peptide
  XENP021821 vlCDR2
RMSNLAS

SEQ ID NO: 27465 - protein, 9 aa, Artificial Sequence
  Description of Artificial Sequence: Synthetic peptide
  XENP021821 vlCDR3
MQHLEYPWT

SEQ ID NO: 27466 - protein, 454 aa, Artificial Sequence; identical to SEQ ID NO: 26322
  Description of Artificial Sequence: Synthetic polypeptide
  XENP021822 jMab-138[ICOS]_H0L0_IgG1_PVA_/S267K Heavy Chain

SEQ ID NO: 27467 - protein, 125 aa, Artificial Sequence; identical to SEQ ID NO: 26323
  Description of Artificial Sequence: Synthetic polypeptide
  VH of XENP021822

SEQ ID NO: 27468 - protein, 5 aa, Artificial Sequence
  Description of Artificial Sequence: Synthetic peptide
  XENP021822 vhCDR1
SYDMH

SEQ ID NO: 27469 - protein, 16 aa, Artificial Sequence
  Description of Artificial Sequence: Synthetic peptide
  XENP021822 vhCDR2
AIGTAGDTYYPGSVKG

SEQ ID NO: 27470 - protein, 17 aa, Artificial Sequence
  Description of Artificial Sequence: Synthetic peptide
  XENP021822 vhCDR3
DNRKVTHEHYYYYGMDV

SEQ ID NO: 27471 - protein, 216 aa, Artificial Sequence; identical to SEQ ID NO: 26327
  Description of Artificial Sequence: Synthetic polypeptide
  XENP021822 jMab-138[ICOS]_H0L0_IgG1_PVA_/S267K Light Chain

SEQ ID NO: 27472 - protein, 109 aa, Artificial Sequence; identical to SEQ ID NO: 26328
  Description of Artificial Sequence: Synthetic polypeptide
  VL of XENP021822

SEQ ID NO: 27473 - protein, 12 aa, Artificial Sequence
  Description of Artificial Sequence: Synthetic peptide
  XENP021822 vlCDR1
RASQNIRSSYLA

SEQ ID NO: 27474 - protein, 7 aa, Artificial Sequence
  Description of Artificial Sequence: Synthetic peptide
  XENP021822 vlCDR2
GASSRAT

SEQ ID NO: 27475 - protein, 10 aa, Artificial Sequence
  Description of Artificial Sequence: Synthetic peptide
  XENP021822 vlCDR3
QQFGSSPMCS

SEQ ID NO: 27476 - protein, 454 aa, Artificial Sequence; identical to SEQ ID NO: 26332
  Description of Artificial Sequence: Synthetic polypeptide
  XENP021823 jMab-139[ICOS]_H0L0_IgG1_PVA_/S267K Heavy Chain

SEQ ID NO: 27477 - protein, 125 aa, Artificial Sequence; identical to SEQ ID NO: 26333
  Description of Artificial Sequence: Synthetic polypeptide
  VH of XENP021823

SEQ ID NO: 27478 - protein, 5 aa, Artificial Sequence
  Description of Artificial Sequence: Synthetic peptide
  XENP021823 vhCDR1
SYDMH

SEQ ID NO: 27479 - protein, 16 aa, Artificial Sequence
  Description of Artificial Sequence: Synthetic peptide
  XENP021823 vhCDR2
AIGTAGDTYYPGSVKG

SEQ ID NO: 27480 - protein, 17 aa, Artificial Sequence
  Description of Artificial Sequence: Synthetic peptide
  XENP021823 vhCDR3
DKRTVTHEHYYYYGMDV

SEQ ID NO: 27481 - protein, 216 aa, Artificial Sequence; identical to SEQ ID NO: 26337
  Description of Artificial Sequence: Synthetic polypeptide
  XENP021823 jMab-139[ICOS]_H0L0_IgG1_PVA_/S267K Light Chain

SEQ ID NO: 27482 - protein, 109 aa, Artificial Sequence; identical to SEQ ID NO: 26338
  Description of Artificial Sequence: Synthetic polypeptide
  VL of XENP021823

SEQ ID NO: 27483 - protein, 12 aa, Artificial Sequence
  Description of Artificial Sequence: Synthetic peptide
  XENP021823 vlCDR1
RASQSISSSSLA

SEQ ID NO: 27484 - protein, 7 aa, Artificial Sequence
  Description of Artificial Sequence: Synthetic peptide
  XENP021823 vlCDR2
GASSRAT

SEQ ID NO: 27485 - protein, 10 aa, Artificial Sequence
  Description of Artificial Sequence: Synthetic peptide
  XENP021823 vlCDR3
QQFGSSPMCS

SEQ ID NO: 27486 - protein, 450 aa, Artificial Sequence; identical to SEQ ID NO: 26342
  Description of Artificial Sequence: Synthetic polypeptide
  XENP022346 WO2016059602_GSK[ICOS]_H0L0 _IgG1_PVA_/S267K Heavy Chain

SEQ ID NO: 27487 - protein, 121 aa, Artificial Sequence; identical to SEQ ID NO: 26343
  Description of Artificial Sequence: Synthetic polypeptide
  VH of XENP022346

SEQ ID NO: 27488 - protein, 5 aa, Artificial Sequence
  Description of Artificial Sequence: Synthetic peptide
  XENP022346 vhCDR1
DYAMH

SEQ ID NO: 27489 - protein, 17 aa, Artificial Sequence
  Description of Artificial Sequence: Synthetic peptide
  XENP022346 vhCDR2
LISIYSDHTNYNQKFQG

SEQ ID NO: 27490 - protein, 12 aa, Artificial Sequence
  Description of Artificial Sequence: Synthetic peptide
  XENP022346 vhCDR3
NNYGNYGWYFDV

SEQ ID NO: 27491 - protein, 213 aa, Artificial Sequence; identical to SEQ ID NO: 26347
  Description of Artificial Sequence: Synthetic polypeptide
  XENP022346 WO2016059602_GSK[ICOS]_H0L0 _IgG1_PVA_/S267K Light Chain

SEQ ID NO: 27492 - protein, 106 aa, Artificial Sequence; identical to SEQ ID NO: 26348
  Description of Artificial Sequence: Synthetic polypeptide
  VL of XENP022346

SEQ ID NO: 27493 - protein, 10 aa, Artificial Sequence
  Description of Artificial Sequence: Synthetic peptide
  XENP022346 vlCDR1
SASSSVSYMH

SEQ ID NO: 27494 - protein, 7 aa, Artificial Sequence
  Description of Artificial Sequence: Synthetic peptide
  XENP022346 vlCDR2
DTSKLAS

SEQ ID NO: 27495 - protein, 9 aa, Artificial Sequence
  Description of Artificial Sequence: Synthetic peptide
  XENP022346 vlCDR3
FQGSGYPYT

SEQ ID NO: 27496 - protein, 446 aa, Artificial Sequence; identical to SEQ ID NO: 26352
  Description of Artificial Sequence: Synthetic polypeptide
  XENP023057 Jounce_37A10S713[ICOS]_H0L0 _IgG1_PVA_/S267K Heavy Chain

SEQ ID NO: 27497 - protein, 117 aa, Artificial Sequence; identical to SEQ ID NO: 26353
  Description of Artificial Sequence: Synthetic polypeptide
  VH of XENP023057

SEQ ID NO: 27498 - protein, 5 aa, Artificial Sequence
  Description of Artificial Sequence: Synthetic peptide
  XENP023057 vhCDR1
DYWMD

SEQ ID NO: 27499 - protein, 17 aa, Artificial Sequence
  Description of Artificial Sequence: Synthetic peptide
  XENP023057 vhCDR2
NIDEDGSITEYSPFVKG

SEQ ID NO: 27500 - protein, 8 aa, Artificial Sequence
  Description of Artificial Sequence: Synthetic peptide
  XENP023057 vhCDR3
WGRFGFDS

SEQ ID NO: 27501 - protein, 218 aa, Artificial Sequence; identical to SEQ ID NO: 26357
  Description of Artificial Sequence: Synthetic polypeptide
  XENP023057 Jounce_37A10S713[ICOS]_H0L0 _IgG1_PVA_/S267K Light Chain

SEQ ID NO: 27502 - protein, 111 aa, Artificial Sequence; identical to SEQ ID NO: 26358
  Description of Artificial Sequence: Synthetic polypeptide
  VL of XENP023057

SEQ ID NO: 27503 - protein, 15 aa, Artificial Sequence
  Description of Artificial Sequence: Synthetic peptide
  XENP023057 vlCDR1
KSSQSLLSGSFNYLT

SEQ ID NO: 27504 - protein, 7 aa, Artificial Sequence
  Description of Artificial Sequence: Synthetic peptide
  XENP023057 vlCDR2
YASTRHT

SEQ ID NO: 27505 - protein, 9 aa, Artificial Sequence
  Description of Artificial Sequence: Synthetic peptide
  XENP023057 vlCDR3
HHHYNAPPT

SEQ ID NO: 27506 - protein, 447 aa, Artificial Sequence
  Description of Artificial Sequence: Synthetic polypeptide
  XENP016434 YW243.55.S70[PD-L1]_H0L0 _IgG1_PVA_/S267K Heavy Chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27507 - protein, 118 aa, Artificial Sequence [sequence omitted]

SEQ ID NO: 27508 - protein, 5 aa, Artificial Sequence
  Description of Artificial Sequence: Synthetic peptide
  XENP016434 vhCDR1
DSWIH

SEQ ID NO: 27509 - protein, 17 aa, Artificial Sequence
  Description of Artificial Sequence: Synthetic peptide
  XENP016434 vhCDR2
WISPYGGSTYYADSVKG

SEQ ID NO: 27510 - protein, 9 aa, Artificial Sequence
  Description of Artificial Sequence: Synthetic peptide
  XENP016434 vhCDR3
RHWPGGFDY

SEQ ID NO: 27511 - protein, 214 aa, Artificial Sequence; identical to SEQ ID NO: 27132
  Description of Artificial Sequence: Synthetic polypeptide
  XENP016434 YW243.55.S70[PD-L1]_H0L0 _IgG1_PVA_/S267K Light Chain

SEQ ID NO: 27512 - protein, 107 aa, Artificial Sequence [sequence omitted]

SEQ ID NO: 27513 - protein, 11 aa, Artificial Sequence
  Description of Artificial Sequence: Synthetic peptide
  XENP016434 vlCDR1
RASQDVSTAVA

SEQ ID NO: 27514 - protein, 7 aa, Artificial Sequence
  Description of Artificial Sequence: Synthetic peptide
  XENP016434 vlCDR2
SASFLYS

SEQ ID NO: 27515 - protein, 9 aa, Artificial Sequence
  Description of Artificial Sequence: Synthetic peptide
  XENP016434 vlCDR3
QQYLYHPAT

SEQ ID NO: 27516 - protein, 449 aa, Artificial Sequence
  Description of Artificial Sequence: Synthetic polypeptide
  XENP024118 avelumab[PD-L1]_H1L1_IgG1_PVA_/S267K Heavy Chain
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27517 - protein, 120 aa, Artificial Sequence; identical to SEQ ID NO: 3977
  Description of Artificial Sequence: Synthetic polypeptide
  VH of XENP024118

SEQ ID NO: 27518 - protein, 5 aa, Artificial Sequence
  Description of Artificial Sequence: Synthetic peptide
  XENP024118 vhCDR1
SYIMM

SEQ ID NO: 27519 - protein, 17 aa, Artificial Sequence
  Description of Artificial Sequence: Synthetic peptide
  XENP024118 vhCDR2
SIYPSGGITFYADTVKG

SEQ ID NO: 27520 - protein, 11 aa, Artificial Sequence
  Description of Artificial Sequence: Synthetic peptide
  XENP024118 vhCDR3
IKLGTVTTVDY

SEQ ID NO: 27521 - protein, 216 aa, Artificial Sequence; identical to SEQ ID NO: 27172
  Description of Artificial Sequence: Synthetic polypeptide
  XENP024118 avelumab[PD-L1]_H1L1_IgG1_PVA_/S267K Light Chain

SEQ ID NO: 27522 - protein, 110 aa, Artificial Sequence; identical to SEQ ID NO: 3981
  Description of Artificial Sequence: Synthetic polypeptide
  VL of XENP024118

SEQ ID NO: 27523 - protein, 14 aa, Artificial Sequence
  Description of Artificial Sequence: Synthetic peptide
  XENP024118 vlCDR1
TGTSSDVGGYNYVS

SEQ ID NO: 27524 - protein, 7 aa, Artificial Sequence
  Description of Artificial Sequence: Synthetic peptide
  XENP024118 vlCDR2
DVSNRPS

SEQ ID NO: 27525 - protein, 10 aa, Artificial Sequence
  Description of Artificial Sequence: Synthetic peptide
  XENP024118 vlCDR3
SSYTSSSTRV

SEQ ID NO: 27526 - protein, 450 aa, Artificial Sequence
  Description of Artificial Sequence: Synthetic polypeptide
  XENP024119 durvalumab[PD-L1]_H1L1_IgG1_PVA_/S267K Heavy Chain
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27527 - protein, 121 aa, Artificial Sequence; identical to SEQ ID NO: 3961
  Description of Artificial Sequence: Synthetic polypeptide
  VH of XENP024119

SEQ ID NO: 27528 - protein, 5 aa, Artificial Sequence
  Description of Artificial Sequence: Synthetic peptide
  XENP024119 vhCDR1
RYWMS

SEQ ID NO: 27529 - protein, 17 aa, Artificial Sequence
  Description of Artificial Sequence: Synthetic peptide
  XENP024119 vhCDR2
NIKQDGSEKYYVDSVKG

SEQ ID NO: 27530 - protein, 12 aa, Artificial Sequence
  Description of Artificial Sequence: Synthetic peptide
  XENP024119 vhCDR3
EGGWFGELAFDY

SEQ ID NO: 27531 - protein, 215 aa, Artificial Sequence; identical to SEQ ID NO: 27152
  Description of Artificial Sequence: Synthetic polypeptide
  XENP024119 durvalumab[PD-L1]_H1L1_IgG1_PVA_/S267K Light Chain

SEQ ID NO: 27532 - protein, 108 aa, Artificial Sequence; identical to SEQ ID NO: 3965
  Description of Artificial Sequence: Synthetic polypeptide
  VL of XENP024119

SEQ ID NO: 27533 - protein, 12 aa, Artificial Sequence
  Description of Artificial Sequence: Synthetic peptide
  XENP024119 vlCDR1
RASQRVSSSYLA

SEQ ID NO: 27534 - protein, 7 aa, Artificial Sequence
  Description of Artificial Sequence: Synthetic peptide
  XENP024119 vlCDR2
DASSRAT

SEQ ID NO: 27535 - protein, 9 aa, Artificial Sequence
  Description of Artificial Sequence: Synthetic peptide
  XENP024119 vlCDR3
QQYGSLPWT

SEQ ID NO: 27536 - protein, 456 aa, Artificial Sequence
  Description of Artificial Sequence: Synthetic polypeptide
  XENP024120 LOPD180[PD-1]_H1L1_IgG1_PVA_/S267K Heavy Chain
QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27537 - protein, 127 aa, Artificial Sequence; identical to SEQ ID NO: 26823
  Description of Artificial Sequence: Synthetic polypeptide
  VH of XENP024120

SEQ ID NO: 27538 - protein, 7 aa, Artificial Sequence
  Description of Artificial Sequence: Synthetic peptide
  XENP024120 vhCDR1
SGAYYWS

SEQ ID NO: 27539 - protein, 16 aa, Artificial Sequence
  Description of Artificial Sequence: Synthetic peptide
  XENP024120 vhCDR2
YIYYNGNTYYNPSLRS

SEQ ID NO: 27540 - protein, 17 aa, Artificial Sequence
  Description of Artificial Sequence: Synthetic peptide
  XENP024120 vhCDR3
ASDYVWGGYHYFDAFDL

SEQ ID NO: 27541 - protein, 216 aa, Artificial Sequence; identical to SEQ ID NO: 26837
  Description of Artificial Sequence: Synthetic polypeptide
  XENP024120 LOPD180[PD-1]_H1L1_IgG1_PVA_/S267K Light Chain

SEQ ID NO: 27542 - protein, 110 aa, Artificial Sequence; identical to SEQ ID NO: 26838
  Description of Artificial Sequence: Synthetic polypeptide
  VL of XENP024120

SEQ ID NO: 27543 - protein, 13 aa, Artificial Sequence
  Description of Artificial Sequence: Synthetic peptide
  XENP024120 vlCDR1
SGSNSNIGSNSVN

SEQ ID NO: 27544 - protein, 7 aa, Artificial Sequence
  Description of Artificial Sequence: Synthetic peptide
  XENP024120 vlCDR2
GNNQRPS

SEQ ID NO: 27545 - protein, 11 aa, Artificial Sequence
  Description of Artificial Sequence: Synthetic peptide
  XENP024120 vlCDR3
AAWDDSLNGPV

SEQ ID NO: 27546 - protein, 448 aa, Artificial Sequence
  Description of Artificial Sequence: Synthetic polypeptide
  XENP024121 mAb7(1.2)[PD-1]_H1L1_IgG1_PVA_/S267K Heavy Chain
QVQLVQSGAEVKKPGASVKVSCKASGYSFTSYWMNWVRQAPGQGLEWIGVIHPSDSETWLDQKFKDRVTITVDKSTSTAYMELSSLRSEDTAVYYCAREHYGTSPFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27547 - protein, 119 aa, Artificial Sequence; identical to SEQ ID NO: 27009
  Description of Artificial Sequence: Synthetic polypeptide
  VH of XENP024121

SEQ ID NO: 27548 - protein, 5 aa, Artificial Sequence
  Description of Artificial Sequence: Synthetic peptide
  XENP024121 vhCDR1
SYWMN

SEQ ID NO: 27549 - protein, 17 aa, Artificial Sequence
  Description of Artificial Sequence: Synthetic peptide
  XENP024121 vhCDR2
VIHPSDSETWLDQKFKD

SEQ ID NO: 27550 - protein, 10 aa, Artificial Sequence
  Description of Artificial Sequence: Synthetic peptide
  XENP024121 vhCDR3
EHYGTSPFAY

SEQ ID NO: 27551 - protein, 218 aa, Artificial Sequence
  Description of Artificial Sequence: Synthetic polypeptide
  XENP024121 mAb7(1.2)[PD-1]_H1L1_IgG1_PVA_/S267K Light Chain
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27552 - protein, 111 aa, Artificial Sequence; identical to SEQ ID NO: 27008
  Description of Artificial Sequence: Synthetic polypeptide
  VL of XENP024121

SEQ ID NO: 27553 - protein, 15 aa, Artificial Sequence
  Description of Artificial Sequence: Synthetic peptide
  XENP024121 vlCDR1
RASESVDNYGMSFMN

SEQ ID NO: 27554 - protein, 7 aa, Artificial Sequence
  Description of Artificial Sequence: Synthetic peptide
  XENP024121 vlCDR2
AASNQGS

SEQ ID NO: 27555 - protein, 9 aa, Artificial Sequence
  Description of Artificial Sequence: Synthetic peptide
  XENP024121 vlCDR3
QQSKEVPYT

SEQ ID NO: 27556 - protein, 452 aa, Artificial Sequence; identical to SEQ ID NO: 26682
  Description of Artificial Sequence: Synthetic polypeptide
  XENP021832 GSK_314.8[ICOS]_H0L0 _Fab-YW243.55.S70[PD-L1]_H0L0_scFv Fab-Fc Heavy Chain

SEQ ID NO: 27557 - protein, 123 aa, Artificial Sequence; identical to SEQ ID NO: 26303
  Description of Artificial Sequence: Synthetic polypeptide
  VH of XENP021832

SEQ ID NO: 27558 - protein, 5 aa, Artificial Sequence
  Description of Artificial Sequence: Synthetic peptide
  XENP021832 vhCDR1
TYWMH

SEQ ID NO: 27559 - protein, 17 aa, Artificial Sequence
  Description of Artificial Sequence: Synthetic peptide
  XENP021832 vhCDR2
EIDPSDSYVNYNQNFKG

SEQ ID NO: 27560 - protein, 14 aa, Artificial Sequence
  Description of Artificial Sequence: Synthetic peptide
  XENP021832 vhCDR3
SPDYYGTSLAWFDY

SEQ ID NO: 27561 - protein, 471 aa, Artificial Sequence
  Description of Artificial Sequence: Synthetic polypeptide
  XENP021832 GSK_314.8[ICOS]_H0L0 _Fab-YW243.55.S70[PD-L1]_H0L0_scFv scFv-Fc Heavy Chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSGGGGSGGGGSGGGGSDIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27562 - protein, 118 aa, Artificial Sequence [sequence omitted]

SEQ ID NO: 27563 - protein, 107 aa, Artificial Sequence [sequence omitted]

SEQ ID NO: 27564 - protein, 231 aa, Artificial Sequence; identical to SEQ ID NO: 2397
  Description of Artificial Sequence: Synthetic polypeptide
  Fc chain of XENP021832

SEQ ID NO: 27565 - protein, 5 aa, Artificial Sequence
  Description of Artificial Sequence: Synthetic peptide
  XENP021832 vhCDR1
DSWIH

SEQ ID NO: 27566 - protein, 17 aa, Artificial Sequence
  Description of Artificial Sequence: Synthetic peptide
  XENP021832 vhCDR2
WISPYGGSTYYADSVKG

SEQ ID NO: 27567 - protein, 9 aa, Artificial Sequence
  Description of Artificial Sequence: Synthetic peptide
  XENP021832 vhCDR3
RHWPGGFDY

SEQ ID NO: 27568 - protein, 11 aa, Artificial Sequence
  Description of Artificial Sequence: Synthetic peptide
  XENP021832 vlCDR1
RASQDVSTAVA

SEQ ID NO: 27569 - protein, 7 aa, Artificial Sequence
  Description of Artificial Sequence: Synthetic peptide
  XENP021832 vlCDR2
SASFLYS

SEQ ID NO: 27570 - protein, 9 aa, Artificial Sequence
  Description of Artificial Sequence: Synthetic peptide
  XENP021832 vlCDR3
QQYLYHPAT

SEQ ID NO: 27571 - protein, 219 aa, Artificial Sequence; identical to SEQ ID NO: 26307
  Description of Artificial Sequence: Synthetic polypeptide
  XENP021832 GSK_314.8[ICOS]_H0L0 _Fab-YW243.55.S70[PD-L1]_H0L0_scFv Light Chain

SEQ ID NO: 27572 - protein, 112 aa, Artificial Sequence; identical to SEQ ID NO: 26308
  Description of Artificial Sequence: Synthetic polypeptide
  VL of XENP021832

SEQ ID NO: 27573 - protein, 16 aa, Artificial Sequence
  Description of Artificial Sequence: Synthetic peptide
  XENP021832 vlCDR1
RSSKSPLHSNGNIYLY

SEQ ID NO: 27574 - protein, 7 aa, Artificial Sequence
  Description of Artificial Sequence: Synthetic peptide
  XENP021832 vlCDR2
RMSNLAS

SEQ ID NO: 27575 - protein, 9 aa, Artificial Sequence
  Description of Artificial Sequence: Synthetic peptide
  XENP021832 vlCDR3
MQHLEYPYT

SEQ ID NO: 27576 - protein, 453 aa, Artificial Sequence; identical to SEQ ID NO: 26702
  Description of Artificial Sequence: Synthetic polypeptide
  XENP021833 GSK_88.2[ICOS]_H0L0 _Fab-YW243.55.S70[PD-L1]_H0L0_scFv Fab-Fc Heavy Chain

SEQ ID NO: 27577 - protein, 124 aa, Artificial Sequence; identical to SEQ ID NO: 26313
  Description of Artificial Sequence: Synthetic polypeptide
  VH of XENP021833

SEQ ID NO: 27578 - protein, 5 aa, Artificial Sequence
  Description of Artificial Sequence: Synthetic peptide
  XENP021833 vhCDR1
SYWIN

SEQ ID NO: 27579 - protein, 17 aa, Artificial Sequence
  Description of Artificial Sequence: Synthetic peptide
  XENP021833 vhCDR2
NIYPSDSYTNYNQMFKD

SEQ ID NO: 27580 - protein, 15 aa, Artificial Sequence
  Description of Artificial Sequence: Synthetic peptide
  XENP021833 vhCDR3
WNLSYYFDNNYYLDY

SEQ ID NO: 27581 - protein, 471 aa, Artificial Sequence; identical to SEQ ID NO: 27561
  Description of Artificial Sequence: Synthetic polypeptide
  XENP021833 GSK_88.2[ICOS]_H0L0 _Fab-YW243.55.S70[PD-L1]_H0L0_scFv scFv-Fc Heavy Chain

SEQ ID NO: 27582 - protein, 118 aa, Artificial Sequence [sequence omitted]

SEQ ID NO: 27583 - protein, 107 aa, Artificial Sequence [sequence omitted]

SEQ ID NO: 27584 - protein, 231 aa, Artificial Sequence; identical to SEQ ID NO: 2397
  Description of Artificial Sequence: Synthetic polypeptide
  Fc chain of XENP021833

SEQ ID NO: 27585 - protein, 5 aa, Artificial Sequence
  Description of Artificial Sequence: Synthetic peptide
  XENP021833 vhCDR1
DSWIH

SEQ ID NO: 27586 - protein, 17 aa, Artificial Sequence
  Description of Artificial Sequence: Synthetic peptide
  XENP021833 vhCDR2
WISPYGGSTYYADSVKG

SEQ ID NO: 27587 - protein, 9 aa, Artificial Sequence
  Description of Artificial Sequence: Synthetic peptide
  XENP021833 vhCDR3
RHWPGGFDY

SEQ ID NO: 27588 - protein, 11 aa, Artificial Sequence
  Description of Artificial Sequence: Synthetic peptide
  XENP021833 vlCDR1
RASQDVSTAVA

SEQ ID NO: 27589 - protein, 7 aa, Artificial Sequence
  Description of Artificial Sequence: Synthetic peptide
  XENP021833 vlCDR2
SASFLYS

SEQ ID NO: 27590 - protein, 9 aa, Artificial Sequence
  Description of Artificial Sequence: Synthetic peptide
  XENP021833 vlCDR3
QQYLYHPAT

SEQ ID NO: 27591 - protein, 219 aa, Artificial Sequence; identical to SEQ ID NO: 26317
  Description of Artificial Sequence: Synthetic polypeptide
  XENP021833 GSK_88.2[ICOS]_H0L0 _Fab-YW243.55.S70[PD-L1]_H0L0_scFv Light Chain

SEQ ID NO: 27592 - protein, 112 aa, Artificial Sequence; identical to SEQ ID NO: 26318
  Description of Artificial Sequence: Synthetic polypeptide
  VL of XENP021833

SEQ ID NO: 27593 - protein, 16 aa, Artificial Sequence
  Description of Artificial Sequence: Synthetic peptide
  XENP021833 vlCDR1
RSSKSLLHSNGNTYLY

SEQ ID NO: 27594 - protein, 7 aa, Artificial Sequence
  Description of Artificial Sequence: Synthetic peptide
  XENP021833 vlCDR2
RMSNLAS

SEQ ID NO: 27595 - protein, 9 aa, Artificial Sequence
  Description of Artificial Sequence: Synthetic peptide
  XENP021833 vlCDR3
MQHLEYPWT

SEQ ID NO: 27596 - protein, 454 aa, Artificial Sequence; identical to SEQ ID NO: 26722
  Description of Artificial Sequence: Synthetic polypeptide
  XENP021834 jMab-138[ICOS]_H0L0 _Fab-YW243.55.S70[PD-L1]_H0L0_scFv Fab-Fc Heavy Chain

SEQ ID NO: 27597 - protein, 125 aa, Artificial Sequence; identical to SEQ ID NO: 26323
  Description of Artificial Sequence: Synthetic polypeptide
  VH of XENP021834

SEQ ID NO: 27598 - protein, 5 aa, Artificial Sequence
  Description of Artificial Sequence: Synthetic peptide
  XENP021834 vhCDR1
SYDMH

SEQ ID NO: 27599 - protein, 16 aa, Artificial Sequence
  Description of Artificial Sequence: Synthetic peptide
  XENP021834 vhCDR2
AIGTAGDTYYPGSVKG

SEQ ID NO: 27600 - protein, 17 aa, Artificial Sequence
  Description of Artificial Sequence: Synthetic peptide
  XENP021834 vhCDR3
DNRKVTHEHYYYYGMDV

SEQ ID NO: 27601 - protein, 471 aa, Artificial Sequence; identical to SEQ ID NO: 27561
  Description of Artificial Sequence: Synthetic polypeptide
  XENP021834 jMab-138[ICOS]_H0L0 _Fab-YW243.55.S70[PD-L1]_H0L0_scFv scFv-Fc Heavy Chain

SEQ ID NO: 27602 - protein, 118 aa, Artificial Sequence [sequence omitted]

SEQ ID NO: 27603 - protein, 107 aa, Artificial Sequence [sequence omitted]

SEQ ID NO: 27604 - protein, 231 aa, Artificial Sequence; identical to SEQ ID NO: 2397
  Description of Artificial Sequence: Synthetic polypeptide
  Fc chain of XENP021834

SEQ ID NO: 27605 - protein, 5 aa, Artificial Sequence
  Description of Artificial Sequence: Synthetic peptide
  XENP021834 vhCDR1
DSWIH

SEQ ID NO: 27606 - protein, 17 aa, Artificial Sequence
  Description of Artificial Sequence: Synthetic peptide
  XENP021834 vhCDR2
WISPYGGSTYYADSVKG

SEQ ID NO: 27607 - protein, 9 aa, Artificial Sequence
  Description of Artificial Sequence: Synthetic peptide
  XENP021834 vhCDR3
RHWPGGFDY

SEQ ID NO: 27608 - protein, 11 aa, Artificial Sequence
  Description of Artificial Sequence: Synthetic peptide
  XENP021834 vlCDR1
RASQDVSTAVA

SEQ ID NO: 27609 - protein, 7 aa, Artificial Sequence
  Description of Artificial Sequence: Synthetic peptide
  XENP021834 vlCDR2
SASFLYS

SEQ ID NO: 27610 - protein, 9 aa, Artificial Sequence
  Description of Artificial Sequence: Synthetic peptide
  XENP021834 vlCDR3
QQYLYHPAT

SEQ ID NO: 27611 - protein, 216 aa, Artificial Sequence; identical to SEQ ID NO: 26327
  Description of Artificial Sequence: Synthetic polypeptide
  XENP021834 jMab-138[ICOS]_H0L0 _Fab-YW243.55.S70[PD-L1]_H0L0_scFv Light Chain

SEQ ID NO: 27612 - protein, 109 aa, Artificial Sequence; identical to SEQ ID NO: 26328
  Description of Artificial Sequence: Synthetic polypeptide
  VL of XENP021834

SEQ ID NO: 27613 - protein, 12 aa, Artificial Sequence
  Description of Artificial Sequence: Synthetic peptide
  XENP021834 vlCDR1
RASQNIRSSYLA

SEQ ID NO: 27614 - protein, 7 aa, Artificial Sequence
  Description of Artificial Sequence: Synthetic peptide
  XENP021834 vlCDR2
GASSRAT

SEQ ID NO: 27615 - protein, 10 aa, Artificial Sequence
  Description of Artificial Sequence: Synthetic peptide
  XENP021834 vlCDR3
QQFGSSPMCS

SEQ ID NO: 27616 - protein, 454 aa, Artificial Sequence; identical to SEQ ID NO: 26742
  Description of Artificial Sequence: Synthetic polypeptide
  XENP021835 jMab-139[ICOS]_H0L0 _Fab-YW243.55.S70[PD-L1]_H0L0_scFv Fab-Fc Heavy Chain

SEQ ID NO: 27617 - protein, 125 aa, Artificial Sequence; identical to SEQ ID NO: 26333
  Description of Artificial Sequence: Synthetic polypeptide
  VH of XENP021835

SEQ ID NO: 27618 - protein, 5 aa, Artificial Sequence
  Description of Artificial Sequence: Synthetic peptide
  XENP021835 vhCDR1
SYDMH

SEQ ID NO: 27619 - protein, 16 aa, Artificial Sequence
  Description of Artificial Sequence: Synthetic peptide
  XENP021835 vhCDR2
AIGTAGDTYYPGSVKG

SEQ ID NO: 27620 - protein, 17 aa, Artificial Sequence
  Description of Artificial Sequence: Synthetic peptide
  XENP021835 vhCDR3
DKRTVTHEHYYYYGMDV

SEQ ID NO: 27621 - protein, 471 aa, Artificial Sequence; identical to SEQ ID NO: 27561
  Description of Artificial Sequence: Synthetic polypeptide
  XENP021835 jMab-139[ICOS]_H0L0 _Fab-YW243.55.S70[PD-L1]_H0L0_scFv scFv-Fc Heavy Chain

SEQ ID NO: 27622 - protein, 118 aa, Artificial Sequence [sequence omitted]

SEQ ID NO: 27623 - protein, 107 aa, Artificial Sequence [sequence omitted]

SEQ ID NO: 27624 - protein, 231 aa, Artificial Sequence; identical to SEQ ID NO: 2397
  Description of Artificial Sequence: Synthetic polypeptide
  Fc chain of XENP021835

SEQ ID NO: 27625 - protein, 5 aa, Artificial Sequence
  Description of Artificial Sequence: Synthetic peptide
  XENP021835 vhCDR1
DSWIH

SEQ ID NO: 27626 - protein, 17 aa, Artificial Sequence
  Description of Artificial Sequence: Synthetic peptide
  XENP021835 vhCDR2
WISPYGGSTYYADSVKG

SEQ ID NO: 27627 - protein, 9 aa, Artificial Sequence
  Description of Artificial Sequence: Synthetic peptide
  XENP021835 vhCDR3
RHWPGGFDY

SEQ ID NO: 27628 - protein, 11 aa, Artificial Sequence
  Description of Artificial Sequence: Synthetic peptide
  XENP021835 vlCDR1
RASQDVSTAVA

SEQ ID NO: 27629 - protein, 7 aa, Artificial Sequence
  Description of Artificial Sequence: Synthetic peptide
  XENP021835 vlCDR2
SASFLYS

SEQ ID NO: 27630 - protein, 9 aa, Artificial Sequence
  Description of Artificial Sequence: Synthetic peptide
  XENP021835 vlCDR3
QQYLYHPAT

SEQ ID NO: 27631 - protein, 216 aa, Artificial Sequence; identical to SEQ ID NO: 26337
  Description of Artificial Sequence: Synthetic polypeptide
  XENP021835 jMab-139[ICOS]_H0L0 _Fab-YW243.55.S70[PD-L1]_H0L0_scFv Light Chain

SEQ ID NO: 27632 - protein, 109 aa, Artificial Sequence; identical to SEQ ID NO: 26338
  Description of Artificial Sequence: Synthetic polypeptide
  VL of XENP021835

SEQ ID NO: 27633 - protein, 12 aa, Artificial Sequence
  Description of Artificial Sequence: Synthetic peptide
  XENP021835 vlCDR1
RASQSISSSSLA

SEQ ID NO: 27634 - protein, 7 aa, Artificial Sequence
  Description of Artificial Sequence: Synthetic peptide
  XENP021835 vlCDR2
GASSRAT

SEQ ID NO: 27635 - protein, 10 aa, Artificial Sequence
  Description of Artificial Sequence: Synthetic peptide
  XENP021835 vlCDR3
QQFGSSPMCS

SEQ ID NO: 27636 - protein, 454 aa, Artificial Sequence; identical to SEQ ID NO: 26442
  Description of Artificial Sequence: Synthetic polypeptide
  XENP021836 jMab-136[ICOS]_H0L0 _Fab-YW243.55.S70[PD-L1]_H0L0_scFv Fab-Fc Heavy Chain

SEQ ID NO: 27637 - protein, 125 aa, Artificial Sequence; identical to SEQ ID NO: 26293
  Description of Artificial Sequence: Synthetic polypeptide
  VH of XENP021836

SEQ ID NO: 27638 - protein, 5 aa, Artificial Sequence
  Description of Artificial Sequence: Synthetic peptide
  XENP021836 vhCDR1
GYYMH

SEQ ID NO: 27639 - protein, 17 aa, Artificial Sequence
  Description of Artificial Sequence: Synthetic peptide
  XENP021836 vhCDR2
WINPHSGGTNYAQKFQG

SEQ ID NO: 27640 - protein, 16 aa, Artificial Sequence
  Description of Artificial Sequence: Synthetic peptide
  XENP021836 vhCDR3
TYYYDSSGYYHDAFDI

SEQ ID NO: 27641 - protein, 471 aa, Artificial Sequence; identical to SEQ ID NO: 27561
  Description of Artificial Sequence: Synthetic polypeptide
  XENP021836 jMab-136[ICOS]_H0L0 _Fab-YW243.55.S70[PD-L1]_H0L0_scFv scFv-Fc Heavy Chain

SEQ ID NO: 27642 - protein, 118 aa, Artificial Sequence [sequence omitted]

SEQ ID NO: 27643 - protein, 107 aa, Artificial Sequence [sequence omitted]

SEQ ID NO: 27644 - protein, 231 aa, Artificial Sequence; identical to SEQ ID NO: 2397
  Description of Artificial Sequence: Synthetic polypeptide
  Fc chain of XENP021836

SEQ ID NO: 27645 - protein, 5 aa, Artificial Sequence
  Description of Artificial Sequence: Synthetic peptide
  XENP021836 vhCDR1
DSWIH

SEQ ID NO: 27646 - protein, 17 aa, Artificial Sequence
  Description of Artificial Sequence: Synthetic peptide
  XENP021836 vhCDR2
WISPYGGSTYYADSVKG

SEQ ID NO: 27647 - protein, 9 aa, Artificial Sequence
  Description of Artificial Sequence: Synthetic peptide
  XENP021836 vhCDR3
RHWPGGFDY

SEQ ID NO: 27648 - protein, 11 aa, Artificial Sequence
  Description of Artificial Sequence: Synthetic peptide
  XENP021836 vlCDR1
RASQDVSTAVA

SEQ ID NO: 27649 - protein, 7 aa, Artificial Sequence
  Description of Artificial Sequence: Synthetic peptide
  XENP021836 vlCDR2
SASFLYS

SEQ ID NO: 27650 - protein, 9 aa, Artificial Sequence
  Description of Artificial Sequence: Synthetic peptide
  XENP021836 vlCDR3
QQYLYHPAT

SEQ ID NO: 27651 - protein, 214 aa, Artificial Sequence; identical to SEQ ID NO: 26297
  Description of Artificial Sequence: Synthetic polypeptide
  XENP021836 jMab-136[ICOS]_H0L0 _Fab-YW243.55.S70[PD-L1]_H0L0_scFv Light Chain

SEQ ID NO: 27652 - protein, 107 aa, Artificial Sequence; identical to SEQ ID NO: 26298
  Description of Artificial Sequence: Synthetic polypeptide
  VL of XENP021836

SEQ ID NO: 27653 - protein, 11 aa, Artificial Sequence
  Description of Artificial Sequence: Synthetic peptide
  XENP021836 vlCDR1
RASQGISRLLA

SEQ ID NO: 27654 - protein, 7 aa, Artificial Sequence
  Description of Artificial Sequence: Synthetic peptide
  XENP021836 vlCDR2
VASSLQS

SEQ ID NO: 27655 - protein, 9 aa, Artificial Sequence
  Description of Artificial Sequence: Synthetic peptide
  XENP021836 vlCDR3
QQANSFPWT

SEQ ID NO: 27656 - protein, 442 aa, Artificial Sequence; identical to SEQ ID NO: 26802
  Description of Artificial Sequence: Synthetic polypeptide
  XENP018920 nivolumab[PD-1]_H0L0 _Fab-[anti-ICOS]_H0L0_scFv Fab-Fc Heavy Chain

SEQ ID NO: 27657 - protein, 113 aa, Artificial Sequence [sequence omitted]

SEQ ID NO: 27658 - protein, 5 aa, Artificial Sequence
  Description of Artificial Sequence: Synthetic peptide
  XENP018920 vhCDR1
NSGMH

SEQ ID NO: 27659 - protein, 17 aa, Artificial Sequence
  Description of Artificial Sequence: Synthetic peptide
  XENP018920 vhCDR2
VIWYDGSKRYYADSVKG

SEQ ID NO: 27660 - protein, 4 aa, Artificial Sequence
  Description of Artificial Sequence: Synthetic peptide
  XENP018920 vhCDR3
NDDY

SEQ ID NO: 27661 - protein, 471 aa, Artificial Sequence; identical to SEQ ID NO: 26807
  Description of Artificial Sequence: Synthetic polypeptide
  XENP018920 nivolumab[PD-1]_H0L0 _Fab-[anti-ICOS]_H0L0_scFv scFv-Fc Heavy Chain

SEQ ID NO: 27662 - protein, 113 aa, Artificial Sequence; identical to SEQ ID NO: 10886
  Description of Artificial Sequence: Synthetic polypeptide
  VH of XENP018920

SEQ ID NO: 27663 - protein, 107 aa, Artificial Sequence [sequence omitted]

SEQ ID NO: 27664 - protein, 231 aa, Artificial Sequence; identical to SEQ ID NO: 2397
  Description of Artificial Sequence: Synthetic polypeptide
  Fc chain of XENP018920

SEQ ID NO: 27665 - protein, 5 aa, Artificial Sequence
  Description of Artificial Sequence: Synthetic peptide
  XENP018920 vhCDR1
NSGMH

SEQ ID NO: 27666 - protein, 17 aa, Artificial Sequence
  Description of Artificial Sequence: Synthetic peptide
  XENP018920 vhCDR2
VIWYDGSKRYYADSVKG

SEQ ID NO: 27667 - protein, 4 aa, Artificial Sequence
  Description of Artificial Sequence: Synthetic peptide
  XENP018920 vhCDR3
NDDY

SEQ ID NO: 27668 - protein, 11 aa, Artificial Sequence
  Description of Artificial Sequence: Synthetic peptide
  XENP018920 vlCDR1
RASQSVSSYLA

SEQ ID NO: 27669 - protein, 7 aa, Artificial Sequence
  Description of Artificial Sequence: Synthetic peptide
  XENP018920 vlCDR2
DASNRAT

SEQ ID NO: 27670 - protein, 9 aa, Artificial Sequence
  Description of Artificial Sequence: Synthetic peptide
  XENP018920 vlCDR3
QQSSNWPRT

SEQ ID NO: 27671 - protein, 214 aa, Artificial Sequence; identical to SEQ ID NO: 16146
  Description of Artificial Sequence: Synthetic polypeptide
  XENP018920 nivolumab[PD-1]_H0L0 _Fab-[anti-ICOS]_H0L0_scFv Light Chain

SEQ ID NO: 27672 - protein, 107 aa, Artificial Sequence [sequence omitted]

SEQ ID NO: 27673 - protein, 11 aa, Artificial Sequence
  Description of Artificial Sequence: Synthetic peptide
  XENP018920 vlCDR1
RASQSVSSYLA

SEQ ID NO: 27674 - protein, 7 aa, Artificial Sequence
  Description of Artificial Sequence: Synthetic peptide
  XENP018920 vlCDR2
DASNRAT

SEQ ID NO: 27675 - protein, 9 aa, Artificial Sequence
  Description of Artificial Sequence: Synthetic peptide
  XENP018920 vlCDR3
QQSSNWPRT

SEQ ID NO: 27676 - protein, 456 aa, Artificial Sequence; identical to SEQ ID NO: 26822
  Description of Artificial Sequence: Synthetic polypeptide
  XENP024130 LOPD180[PD-1]_H1L1_Fab-[anti-ICOS]_H0L0 _scFv Fab-Fc Heavy Chain

SEQ ID NO: 27677 - protein, 127 aa, Artificial Sequence; identical to SEQ ID NO: 26823
  Description of Artificial Sequence: Synthetic polypeptide
  VH of XENP024130

SEQ ID NO: 27678 - protein, 7 aa, Artificial Sequence
  Description of Artificial Sequence: Synthetic peptide
  XENP024130 vhCDR1
SGAYYWS

SEQ ID NO: 27679 - protein, 16 aa, Artificial Sequence
  Description of Artificial Sequence: Synthetic peptide
  XENP024130 vhCDR2
YIYYNGNTYYNPSLRS

SEQ ID NO: 27680 - protein, 17 aa, Artificial Sequence
  Description of Artificial Sequence: Synthetic peptide
  XENP024130 vhCDR3
ASDYVWGGYHYFDAFDL

SEQ ID NO: 27681 - protein, 483 aa, Artificial Sequence; identical to SEQ ID NO: 26827
  Description of Artificial Sequence: Synthetic polypeptide
  XENP024130 LOPD180[PD-1]_H1L1_Fab-[anti-ICOS]_H0L0 _scFv scFv-Fc Heavy Chain

SEQ ID NO: 27682 - protein, 125 aa, Artificial Sequence; identical to SEQ ID NO: 26293
  Description of Artificial Sequence: Synthetic polypeptide
  VH of XENP024130

SEQ ID NO: 27683 - protein, 107 aa, Artificial Sequence; identical to SEQ ID NO: 26298
  Description of Artificial Sequence: Synthetic polypeptide
  VL of XENP024130

SEQ ID NO: 27684 - protein, 231 aa, Artificial Sequence; identical to SEQ ID NO: 2397
  Description of Artificial Sequence: Synthetic polypeptide
  Fc chain of XENP024130

SEQ ID NO: 27685 - protein, 5 aa, Artificial Sequence
  Description of Artificial Sequence: Synthetic peptide
  XENP024130 vhCDR1
GYYMH

SEQ ID NO: 27686 - protein, 17 aa, Artificial Sequence
  Description of Artificial Sequence: Synthetic peptide
  XENP024130 vhCDR2
WINPHSGGTNYAQKFQG

SEQ ID NO: 27687 - protein, 16 aa, Artificial Sequence
  Description of Artificial Sequence: Synthetic peptide
  XENP024130 vhCDR3
TYYYDSSGYYHDAFDI

SEQ ID NO: 27688 - protein, 11 aa, Artificial Sequence
  Description of Artificial Sequence: Synthetic peptide
  XENP024130 vlCDR1
RASQGISRLLA

SEQ ID NO: 27689 - protein, 7 aa, Artificial Sequence
  Description of Artificial Sequence: Synthetic peptide
  XENP024130 vlCDR2
VASSLQS

SEQ ID NO: 27690 - protein, 9 aa, Artificial Sequence
  Description of Artificial Sequence: Synthetic peptide
  XENP024130 vlCDR3
QQANSFPWT

SEQ ID NO: 27691 - protein, 216 aa, Artificial Sequence; identical to SEQ ID NO: 26837
  Description of Artificial Sequence: Synthetic polypeptide
  XENP024130 LOPD180[PD-1]_H1L1_Fab-[anti-ICOS]_H0L0 _scFv Light Chain

SEQ ID NO: 27692 - protein, 110 aa, Artificial Sequence; identical to SEQ ID NO: 26838
  Description of Artificial Sequence: Synthetic polypeptide
  VL of XENP024130

SEQ ID NO: 27693 - protein, 13 aa, Artificial Sequence
  Description of Artificial Sequence: Synthetic peptide
  XENP024130 vlCDR1
SGSNSNIGSNSVN

SEQ ID NO: 27694 - protein, 7 aa, Artificial Sequence
  Description of Artificial Sequence: Synthetic peptide
  XENP024130 vlCDR2
GNNQRPS

SEQ ID NO: 27695 - protein, 11 aa, Artificial Sequence
  Description of Artificial Sequence: Synthetic peptide
  XENP024130 vlCDR3
AAWDDSLNGPV

SEQ ID NO: 27696 - protein, 452 aa, Artificial Sequence; identical to SEQ ID NO: 26682
  Description of Artificial Sequence: Synthetic polypeptide
  XENP021828 GSK_314.8[ICOS]_H0L0 _Fab-1G6_L1.194_H1.279_scFv Fab-Fc Heavy Chain

SEQ ID NO: 27697 - protein, 123 aa, Artificial Sequence; identical to SEQ ID NO: 26303
  Description of Artificial Sequence: Synthetic polypeptide
  VH of XENP021828

SEQ ID NO: 27698 - protein, 5 aa, Artificial Sequence
  Description of Artificial Sequence: Synthetic peptide
  XENP021828 vhCDR1
TYWMH

SEQ ID NO: 27699 - protein, 17 aa, Artificial Sequence
  Description of Artificial Sequence: Synthetic peptide
  XENP021828 vhCDR2
EIDPSDSYVNYNQNFKG

SEQ ID NO: 27700 - protein, 14 aa, Artificial Sequence
  Description of Artificial Sequence: Synthetic peptide
  XENP021828 vhCDR3
SPDYYGTSLAWFDY

SEQ ID NO: 27701 - protein, 480 aa, Artificial Sequence; identical to SEQ ID NO: 2870
  Description of Artificial Sequence: Synthetic polypeptide
  XENP021828 GSK_314.8[ICOS]_H0L0 _Fab-1G6_L1.194_H1.279_scFv scFv-Fc Heavy Chain

SEQ ID NO: 27702 - protein, 107 aa, Artificial Sequence; identical to SEQ ID NO: 2871
  Description of Artificial Sequence: Synthetic polypeptide
  VH of XENP021828

SEQ ID NO: 27703 - protein, 122 aa, Artificial Sequence; identical to SEQ ID NO: 2872
  Description of Artificial Sequence: Synthetic polypeptide
  VL of XENP021828

SEQ ID NO: 27704 - protein, 231 aa, Artificial Sequence; identical to SEQ ID NO: 2397
  Description of Artificial Sequence: Synthetic polypeptide
  Fc chain of XENP021828

SEQ ID NO: 27705 - protein, 11 aa, Artificial Sequence
  Description of Artificial Sequence: Synthetic peptide
  XENP021828 vhCDR1
RASQSVGNDVA

SEQ ID NO: 27706 - protein, 7 aa, Artificial Sequence
  Description of Artificial Sequence: Synthetic peptide
  XENP021828 vhCDR2
YASHRYT

SEQ ID NO: 27707 - protein, 9 aa, Artificial Sequence
  Description of Artificial Sequence: Synthetic peptide
  XENP021828 vhCDR3
QQDFSSPRT

SEQ ID NO: 27708 - protein, 5 aa, Artificial Sequence
  Description of Artificial Sequence: Synthetic peptide
  XENP021828 vlCDR1
NYWMN

SEQ ID NO: 27709 - protein, 19 aa, Artificial Sequence
  Description of Artificial Sequence: Synthetic peptide
  XENP021828 vlCDR2
EIRLYSNNYATHYAESVKG

SEQ ID NO: 27710 - protein, 11 aa, Artificial Sequence
  Description of Artificial Sequence: Synthetic peptide
  XENP021828 vlCDR3
YYGNYGGYFDV

SEQ ID NO: 27711 - protein, 219 aa, Artificial Sequence; identical to SEQ ID NO: 26307
  Description of Artificial Sequence: Synthetic polypeptide
  XENP021828 GSK_314.8[ICOS]_H0L0 _Fab-1G6_L1.194_H1.279_scFv Light Chain

SEQ ID NO: 27712 - protein, 112 aa, Artificial Sequence; identical to SEQ ID NO: 26308
  Description of Artificial Sequence: Synthetic polypeptide
  VL of XENP021828

SEQ ID NO: 27713 - protein, 16 aa, Artificial Sequence
  Description of Artificial Sequence: Synthetic peptide
  XENP021828 vlCDR1
RSSKSPLHSNGNIYLY

SEQ ID NO: 27714 - protein, 7 aa, Artificial Sequence
  Description of Artificial Sequence: Synthetic peptide
  XENP021828 vlCDR2
RMSNLAS

SEQ ID NO: 27715 - protein, 9 aa, Artificial Sequence
  Description of Artificial Sequence: Synthetic peptide
  XENP021828 vlCDR3
MQHLEYPYT

SEQ ID NO: 27716 - protein, 453 aa, Artificial Sequence; identical to SEQ ID NO: 26702
  Description of Artificial Sequence: Synthetic polypeptide
  XENP021829 GSK_88.2[ICOS]_H0L0 _Fab-1G6_L1.194_H1.279_scFv Fab-Fc Heavy Chain

SEQ ID NO: 27717 - protein, 124 aa, Artificial Sequence; identical to SEQ ID NO: 26313
  Description of Artificial Sequence: Synthetic polypeptide
  VH of XENP021829

SEQ ID NO: 27718 - protein, 5 aa, Artificial Sequence
  Description of Artificial Sequence: Synthetic peptide
  XENP021829 vhCDR1
SYWIN

SEQ ID NO: 27719 - protein, 17 aa, Artificial Sequence
  Description of Artificial Sequence: Synthetic peptide
  XENP021829 vhCDR2
NIYPSDSYTNYNQMFKD

SEQ ID NO: 27720 - protein, 15 aa, Artificial Sequence
  Description of Artificial Sequence: Synthetic peptide
  XENP021829 vhCDR3
WNLSYYFDNNYYLDY

SEQ ID NO: 27721 - protein, 480 aa, Artificial Sequence; identical to SEQ ID NO: 2870
  Description of Artificial Sequence: Synthetic polypeptide
  XENP021829 GSK_88.2[ICOS]_H0L0 _Fab-1G6_L1.194_H1.279_scFv scFv-Fc Heavy Chain

SEQ ID NO: 27722 - protein, 107 aa, Artificial Sequence; identical to SEQ ID NO: 2871
  Description of Artificial Sequence: Synthetic polypeptide
  VH of XENP021829

SEQ ID NO: 27723 - protein, 122 aa, Artificial Sequence; identical to SEQ ID NO: 2872
  Description of Artificial Sequence: Synthetic polypeptide
  VL of XENP021829

SEQ ID NO: 27724 - protein, 231 aa, Artificial Sequence; identical to SEQ ID NO: 2397
  Description of Artificial Sequence: Synthetic polypeptide
  Fc chain of XENP021829

SEQ ID NO: 27725 - protein, 11 aa, Artificial Sequence
  Description of Artificial Sequence: Synthetic peptide
  XENP021829 vhCDR1
RASQSVGNDVA

SEQ ID NO: 27726 - protein, 7 aa, Artificial Sequence
  Description of Artificial Sequence: Synthetic peptide
  XENP021829 vhCDR2
YASHRYT

SEQ ID NO: 27727 - protein, 9 aa, Artificial Sequence
  Description of Artificial Sequence: Synthetic peptide
  XENP021829 vhCDR3
QQDFSSPRT

SEQ ID NO: 27728 - protein, 5 aa, Artificial Sequence
  Description of Artificial Sequence: Synthetic peptide
  XENP021829 vlCDR1
NYWMN

SEQ ID NO: 27729 - protein, 19 aa, Artificial Sequence
  Description of Artificial Sequence: Synthetic peptide
  XENP021829 vlCDR2
EIRLYSNNYATHYAESVKG

SEQ ID NO: 27730 - protein, 11 aa, Artificial Sequence
  Description of Artificial Sequence: Synthetic peptide
  XENP021829 vlCDR3
YYGNYGGYFDV

SEQ ID NO: 27731 - protein, 219 aa, Artificial Sequence; identical to SEQ ID NO: 26317
  Description of Artificial Sequence: Synthetic polypeptide
  XENP021829 GSK_88.2[ICOS]_H0L0 _Fab-1G6_L1.194_H1.279_scFv Light Chain

SEQ ID NO: 27732 - protein, 112 aa, Artificial Sequence; identical to SEQ ID NO: 26318
  Description of Artificial Sequence: Synthetic polypeptide
  VL of XENP021829

SEQ ID NO: 27733 - protein, 16 aa, Artificial Sequence
  Description of Artificial Sequence: Synthetic peptide
  XENP021829 vlCDR1
RSSKSLLHSNGNTYLY

SEQ ID NO: 27734 - protein, 7 aa, Artificial Sequence
  Description of Artificial Sequence: Synthetic peptide
  XENP021829 vlCDR2
RMSNLAS

SEQ ID NO: 27735 - protein, 9 aa, Artificial Sequence
  Description of Artificial Sequence: Synthetic peptide
  XENP021829 vlCDR3
MQHLEYPWT

SEQ ID NO: 27736 - protein, 454 aa, Artificial Sequence; identical to SEQ ID NO: 26722
  Description of Artificial Sequence: Synthetic polypeptide
  XENP021830 jMab-138[ICOS]_H0L0 _Fab-1G6_L1.194_H1.279_scFv Fab-Fc Heavy Chain

SEQ ID NO: 27737 - protein, 125 aa, Artificial Sequence; identical to SEQ ID NO: 26323
  Description of Artificial Sequence: Synthetic polypeptide
  VH of XENP021830

SEQ ID NO: 27738 - protein, 5 aa, Artificial Sequence
  Description of Artificial Sequence: Synthetic peptide
  XENP021830 vhCDR1
SYDMH

SEQ ID NO: 27739 - protein, 16 aa, Artificial Sequence
  Description of Artificial Sequence: Synthetic peptide
  XENP021830 vhCDR2
AIGTAGDTYYPGSVKG

SEQ ID NO: 27740 - protein, 17 aa, Artificial Sequence
  Description of Artificial Sequence: Synthetic peptide
  XENP021830 vhCDR3
DNRKVTHEHYYYYGMDV

SEQ ID NO: 27741 - protein, 480 aa, Artificial Sequence; identical to SEQ ID NO: 2870
  Description of Artificial Sequence: Synthetic polypeptide
  XENP021830 jMab-138[ICOS]_H0L0 _Fab-1G6_L1.194_H1.279_scFv scFv-Fc Heavy Chain

SEQ ID NO: 27742 - protein, 107 aa, Artificial Sequence; identical to SEQ ID NO: 2871
  Description of Artificial Sequence: Synthetic polypeptide
  VH of XENP021830

SEQ ID NO: 27743 - protein, 122 aa, Artificial Sequence; identical to SEQ ID NO: 2872
  Description of Artificial Sequence: Synthetic polypeptide
  VL of XENP021830

SEQ ID NO: 27744 - protein, 231 aa, Artificial Sequence; identical to SEQ ID NO: 2397
  Description of Artificial Sequence: Synthetic polypeptide
  Fc chain of XENP021830

SEQ ID NO: 27745 - protein, 11 aa, Artificial Sequence
  Description of Artificial Sequence: Synthetic peptide
  XENP021830 vhCDR1
RASQSVGNDVA

SEQ ID NO: 27746 - protein, 7 aa, Artificial Sequence
  Description of Artificial Sequence: Synthetic peptide
  XENP021830 vhCDR2
YASHRYT

SEQ ID NO: 27747 - protein, 9 aa, Artificial Sequence
  Description of Artificial Sequence: Synthetic peptide
  XENP021830 vhCDR3
QQDFSSPRT

SEQ ID NO: 27748 - protein, 5 aa, Artificial Sequence
  Description of Artificial Sequence: Synthetic peptide
  XENP021830 vlCDR1
NYWMN

SEQ ID NO: 27749 - protein, 19 aa, Artificial Sequence
  Description of Artificial Sequence: Synthetic peptide
  XENP021830 vlCDR2
EIRLYSNNYATHYAESVKG

SEQ ID NO: 27750 - protein, 11 aa, Artificial Sequence
  Description of Artificial Sequence: Synthetic peptide
  XENP021830 vlCDR3
YYGNYGGYFDV

SEQ ID NO: 27751 - protein, 216 aa, Artificial Sequence; identical to SEQ ID NO: 26327
  Description of Artificial Sequence: Synthetic polypeptide
  XENP021830 jMab-138[ICOS]_H0L0 _Fab-1G6_L1.194_H1.279_scFv Light Chain

SEQ ID NO: 27752 - protein, 109 aa, Artificial Sequence; identical to SEQ ID NO: 26328
  Description of Artificial Sequence: Synthetic polypeptide
  VL of XENP021830

SEQ ID NO: 27753 - protein, 12 aa, Artificial Sequence
  Description of Artificial Sequence: Synthetic peptide
  XENP021830 vlCDR1
RASQNIRSSYLA

SEQ ID NO: 27754 - protein, 7 aa, Artificial Sequence
  Description of Artificial Sequence: Synthetic peptide
  XENP021830 vlCDR2
GASSRAT

SEQ ID NO: 27755 - protein, 10 aa, Artificial Sequence
  Description of Artificial Sequence: Synthetic peptide
  XENP021830 vlCDR3
QQFGSSPMCS

SEQ ID NO: 27756 - protein, 454 aa, Artificial Sequence; identical to SEQ ID NO: 26742
  Description of Artificial Sequence: Synthetic polypeptide
  XENP021831 jMab-139[ICOS]_H0L0 _Fab-1G6_L1.194_H1.279_scFv Fab-Fc Heavy Chain

SEQ ID NO: 27757 - protein, 125 aa, Artificial Sequence; identical to SEQ ID NO: 26333
  Description of Artificial Sequence: Synthetic polypeptide
  VH of XENP021831

SEQ ID NO: 27758 - protein, 5 aa, Artificial Sequence
  Description of Artificial Sequence: Synthetic peptide
  XENP021831 vhCDR1
SYDMH

SEQ ID NO: 27759 - protein, 16 aa, Artificial Sequence
  Description of Artificial Sequence: Synthetic peptide
  XENP021831 vhCDR2
AIGTAGDTYYPGSVKG

SEQ ID NO: 27760 - protein, 17 aa, Artificial Sequence
  Description of Artificial Sequence: Synthetic peptide
  XENP021831 vhCDR3
DKRTVTHEHYYYYGMDV

SEQ ID NO: 27761 - protein, 480 aa, Artificial Sequence; identical to SEQ ID NO: 2870
  Description of Artificial Sequence: Synthetic polypeptide
  XENP021831 jMab-139[ICOS]_H0L0 _Fab-1G6_L1.194_H1.279_scFv scFv-Fc Heavy Chain

SEQ ID NO: 27762 - protein, 107 aa, Artificial Sequence; identical to SEQ ID NO: 2871
  Description of Artificial Sequence: Synthetic polypeptide
  VH of XENP021831

SEQ ID NO: 27763 - protein, 122 aa, Artificial Sequence; identical to SEQ ID NO: 2872
  Description of Artificial Sequence: Synthetic polypeptide
  VL of XENP021831

SEQ ID NO: 27764 - protein, 231 aa, Artificial Sequence; identical to SEQ ID NO: 2397
  Description of Artificial Sequence: Synthetic polypeptide
  Fc chain of XENP021831

SEQ ID NO: 27765 - protein, 11 aa, Artificial Sequence
  Description of Artificial Sequence: Synthetic peptide
  XENP021831 vhCDR1
RASQSVGNDVA

SEQ ID NO: 27766 - protein, 7 aa, Artificial Sequence
  Description of Artificial Sequence: Synthetic peptide
  XENP021831 vhCDR2
YASHRYT

SEQ ID NO: 27767 - protein, 9 aa, Artificial Sequence
  Description of Artificial Sequence: Synthetic peptide
  XENP021831 vhCDR3
QQDFSSPRT

SEQ ID NO: 27768 - protein, 5 aa, Artificial Sequence
  Description of Artificial Sequence: Synthetic peptide
  XENP021831 vlCDR1
NYWMN

SEQ ID NO: 27769 - protein, 19 aa, Artificial Sequence
  Description of Artificial Sequence: Synthetic peptide
  XENP021831 vlCDR2
EIRLYSNNYATHYAESVKG

SEQ ID NO: 27770 - protein, 11 aa, Artificial Sequence
  Description of Artificial Sequence: Synthetic peptide
  XENP021831 vlCDR3
YYGNYGGYFDV

SEQ ID NO: 27771 - protein, 216 aa, Artificial Sequence; identical to SEQ ID NO: 26337
  Description of Artificial Sequence: Synthetic polypeptide
  XENP021831 jMab-139[ICOS]_H0L0 _Fab-1G6_L1.194_H1.279_scFv Light Chain

SEQ ID NO: 27772 - protein, 109 aa, Artificial Sequence; identical to SEQ ID NO: 26338
  Description of Artificial Sequence: Synthetic polypeptide
  VL of XENP021831

SEQ ID NO: 27773 - protein, 12 aa, Artificial Sequence
  Description of Artificial Sequence: Synthetic peptide
  XENP021831 vlCDR1
RASQSISSSSLA

SEQ ID NO: 27774 - protein, 7 aa, Artificial Sequence
  Description of Artificial Sequence: Synthetic peptide
  XENP021831 vlCDR2
GASSRAT

SEQ ID NO: 27775 - protein, 10 aa, Artificial Sequence
  Description of Artificial Sequence: Synthetic peptide
  XENP021831 vlCDR3
QQFGSSPMCS

SEQ ID NO: 27776 - protein, 450 aa, Artificial Sequence; identical to SEQ ID NO: 26762
  Description of Artificial Sequence: Synthetic polypeptide
  XENP022348 WO2016059602_GSK_H0L0 _Fab-1G6_L1.194_H1.279_scFv Fab-Fc Heavy Chain

SEQ ID NO: 27777 - protein, 121 aa, Artificial Sequence; identical to SEQ ID NO: 26343
  Description of Artificial Sequence: Synthetic polypeptide
  VH of XENP022348

SEQ ID NO: 27778 - protein, 5 aa, Artificial Sequence
  Description of Artificial Sequence: Synthetic peptide
  XENP022348 vhCDR1
DYAMH

SEQ ID NO: 27779 - protein, 17 aa, Artificial Sequence
  Description of Artificial Sequence: Synthetic peptide
  XENP022348 vhCDR2
LISIYSDHTNYNQKFQG

SEQ ID NO: 27780 - protein, 12 aa, Artificial Sequence
  Description of Artificial Sequence: Synthetic peptide
  XENP022348 vhCDR3
NNYGNYGWYFDV

SEQ ID NO: 27781 - protein, 480 aa, Artificial Sequence; identical to SEQ ID NO: 2870
  Description of Artificial Sequence: Synthetic polypeptide
  XENP022348 WO2016059602_GSK_H0L0 _Fab-1G6_L1.194_H1.279_scFv scFv-Fc Heavy Chain

SEQ ID NO: 27782 - protein, 107 aa, Artificial Sequence; identical to SEQ ID NO: 2871
  Description of Artificial Sequence: Synthetic polypeptide
  VH of XENP022348

SEQ ID NO: 27783 - protein, 122 aa, Artificial Sequence; identical to SEQ ID NO: 2872
  Description of Artificial Sequence: Synthetic polypeptide
  VL of XENP022348

SEQ ID NO: 27784 - protein, 231 aa, Artificial Sequence; identical to SEQ ID NO: 2397
  Description of Artificial Sequence: Synthetic polypeptide
  Fc chain of XENP022348

SEQ ID NO: 27785 - protein, 11 aa, Artificial Sequence
  Description of Artificial Sequence: Synthetic peptide
  XENP022348 vhCDR1
RASQSVGNDVA

SEQ ID NO: 27786 - protein, 7 aa, Artificial Sequence
  Description of Artificial Sequence: Synthetic peptide
  XENP022348 vhCDR2
YASHRYT

SEQ ID NO: 27787 - protein, 9 aa, Artificial Sequence
  Description of Artificial Sequence: Synthetic peptide
  XENP022348 vhCDR3
QQDFSSPRT

SEQ ID NO: 27788 - protein, 5 aa, Artificial Sequence
  Description of Artificial Sequence: Synthetic peptide
  XENP022348 vlCDR1
NYWMN

SEQ ID NO: 27789 - protein, 19 aa, Artificial Sequence
  Description of Artificial Sequence: Synthetic peptide
  XENP022348 vlCDR2
EIRLYSNNYATHYAESVKG

SEQ ID NO: 27790 - protein, 11 aa, Artificial Sequence
  Description of Artificial Sequence: Synthetic peptide
  XENP022348 vlCDR3
YYGNYGGYFDV

SEQ ID NO: 27791 - protein, 213 aa, Artificial Sequence; identical to SEQ ID NO: 26347
  Description of Artificial Sequence: Synthetic polypeptide
  XENP022348 WO2016059602_GSK_H0L0 _Fab-1G6_L1.194_H1.279_scFv Light Chain

SEQ ID NO: 27792 - protein, 106 aa, Artificial Sequence; identical to SEQ ID NO: 26348
  Description of Artificial Sequence: Synthetic polypeptide
  VL of XENP022348

SEQ ID NO: 27793 - protein, 10 aa, Artificial Sequence
  Description of Artificial Sequence: Synthetic peptide
  XENP022348 vlCDR1
SASSSVSYMH

SEQ ID NO: 27794 - protein, 7 aa, Artificial Sequence
  Description of Artificial Sequence: Synthetic peptide
  XENP022348 vlCDR2
DTSKLAS

SEQ ID NO: 27795 - protein, 9 aa, Artificial Sequence
  Description of Artificial Sequence: Synthetic peptide
  XENP022348 vlCDR3
FQGSGYPYT

SEQ ID NO: 27796 - protein, 447 aa, Artificial Sequence; identical to SEQ ID NO: 27117
  Description of Artificial Sequence: Synthetic polypeptide
  XENP021748 YW243.55.S70[PD-L1]_H0L0 _Fab-[anti-ICOS]_H0L0 _scFv Fab-Fc Heavy Chain

SEQ ID NO: 27797 - protein, 118 aa, Artificial Sequence [sequence omitted]

SEQ ID NO: 27798 - protein, 5 aa, Artificial Sequence
  Description of Artificial Sequence: Synthetic peptide
  XENP021748 vhCDR1
DSWIH

SEQ ID NO: 27799 - protein, 17 aa, Artificial Sequence
  Description of Artificial Sequence: Synthetic peptide
  XENP021748 vhCDR2
WISPYGGSTYYADSVKG

SEQ ID NO: 27800 - protein, 9 aa, Artificial Sequence
  Description of Artificial Sequence: Synthetic peptide
  XENP021748 vhCDR3
RHWPGGFDY

SEQ ID NO: 27801 - protein, 483 aa, Artificial Sequence; identical to SEQ ID NO: 26827
  Description of Artificial Sequence: Synthetic polypeptide
  XENP021748 YW243.55.S70[PD-L1]_H0L0 _Fab-[anti-ICOS]_H0L0_scFv scFv-Fc Heavy Chain

SEQ ID NO: 27802 - protein, 125 aa, Artificial Sequence; identical to SEQ ID NO: 26293
  Description of Artificial Sequence: Synthetic polypeptide
  VH of XENP021748

SEQ ID NO: 27803 - protein, 107 aa, Artificial Sequence; identical to SEQ ID NO: 26298
  Description of Artificial Sequence: Synthetic polypeptide
  VL of XENP021748

SEQ ID NO: 27804 - protein, 231 aa, Artificial Sequence; identical to SEQ ID NO: 2397
  Description of Artificial Sequence: Synthetic polypeptide
  Fc chain of XENP021748

SEQ ID NO: 27805 - protein, 5 aa, Artificial Sequence
  Description of Artificial Sequence: Synthetic peptide
  XENP021748 vhCDR1
GYYMH

SEQ ID NO: 27806 - protein, 17 aa, Artificial Sequence
  Description of Artificial Sequence: Synthetic peptide
  XENP021748 vhCDR2
WINPHSGGTNYAQKFQG

SEQ ID NO: 27807 - protein, 16 aa, Artificial Sequence
  Description of Artificial Sequence: Synthetic peptide
  XENP021748 vhCDR3
TYYYDSSGYYHDAFDI

SEQ ID NO: 27808 - protein, 11 aa, Artificial Sequence
  Description of Artificial Sequence: Synthetic peptide
  XENP021748 vlCDR1
RASQGISRLLA

SEQ ID NO: 27809 - protein, 7 aa, Artificial Sequence
  Description of Artificial Sequence: Synthetic peptide
  XENP021748 vlCDR2
VASSLQS

SEQ ID NO: 27810 - protein, 9 aa, Artificial Sequence
  Description of Artificial Sequence: Synthetic peptide
  XENP021748 vlCDR3
QQANSFPWT

SEQ ID NO: 27811 - protein, 214 aa, Artificial Sequence; identical to SEQ ID NO: 27132
  Description of Artificial Sequence: Synthetic polypeptide
  XENP021748 YW243.55.S70[PD-L1]_H0L0 _Fab-[anti-ICOS]_H0L0_scFv Light Chain

SEQ ID NO: 27812 - protein, 107 aa, Artificial Sequence [sequence omitted]

SEQ ID NO: 27813 - protein, 11 aa, Artificial Sequence
  Description of Artificial Sequence: Synthetic peptide
  XENP021748 vlCDR1
RASQDVSTAVA

SEQ ID NO: 27814 - protein, 7 aa, Artificial Sequence
  Description of Artificial Sequence: Synthetic peptide
  XENP021748 vlCDR2
SASFLYS

SEQ ID NO: 27815 - protein, 9 aa, Artificial Sequence
  Description of Artificial Sequence: Synthetic peptide
  XENP021748 vlCDR3
QQYLYHPAT

SEQ ID NO: 27816 - protein, 454 aa, Artificial Sequence; identical to SEQ ID NO: 26442
  Description of Artificial Sequence: Synthetic polypeptide
  XENP021749 [anti-ICOS]_H0L0 _Fab-[anti-CTLA-4]_H3.23_L0.129_scFv Fab-Fc Heavy Chain

SEQ ID NO: 27817 - protein, 125 aa, Artificial Sequence; identical to SEQ ID NO: 26293
  Description of Artificial Sequence: Synthetic polypeptide
  VH of XENP021749

SEQ ID NO: 27818 - protein, 5 aa, Artificial Sequence
  Description of Artificial Sequence: Synthetic peptide
  XENP021749 vhCDR1
GYYMH

SEQ ID NO: 27819 - protein, 17 aa, Artificial Sequence
  Description of Artificial Sequence: Synthetic peptide
  XENP021749 vhCDR2
WINPHSGGTNYAQKFQG

SEQ ID NO: 27820 - protein, 16 aa, Artificial Sequence
  Description of Artificial Sequence: Synthetic peptide
  XENP021749 vhCDR3
TYYYDSSGYYHDAFDI

SEQ ID NO: 27821 - protein, 477 aa, Artificial Sequence; identical to SEQ ID NO: 2394
  Description of Artificial Sequence: Synthetic polypeptide
  XENP021749 [anti-ICOS]_H0L0 _Fab-[anti-CTLA-4]_H3.23_L0.129_scFv scFv-Fc Heavy Chain

SEQ ID NO: 27822 - protein, 118 aa, Artificial Sequence; identical to SEQ ID NO: 2395
  Description of Artificial Sequence: Synthetic polypeptide
  VH of XENP021749

SEQ ID NO: 27823 - protein, 108 aa, Artificial Sequence; identical to SEQ ID NO: 2396
  Description of Artificial Sequence: Synthetic polypeptide
  VL of XENP021749

SEQ ID NO: 27824 - protein, 231 aa, Artificial Sequence; identical to SEQ ID NO: 2397
  Description of Artificial Sequence: Synthetic polypeptide
  Fc chain of XENP021749

SEQ ID NO: 27825 - protein, 5 aa, Artificial Sequence
  Description of Artificial Sequence: Synthetic peptide
  XENP021749 vhCDR1
SYTMH

SEQ ID NO: 27826 - protein, 17 aa, Artificial Sequence
  Description of Artificial Sequence: Synthetic peptide
  XENP021749 vhCDR2
FISYDGNYKYYADSVKG

SEQ ID NO: 27827 - protein, 9 aa, Artificial Sequence
  Description of Artificial Sequence: Synthetic peptide
  XENP021749 vhCDR3
GGHLGPFDL

SEQ ID NO: 27828 - protein, 12 aa, Artificial Sequence
  Description of Artificial Sequence: Synthetic peptide
  XENP021749 vlCDR1
RASQSVGSSYLA

SEQ ID NO: 27829 - protein, 7 aa, Artificial Sequence
  Description of Artificial Sequence: Synthetic peptide
  XENP021749 vlCDR2
GASSRAT

SEQ ID NO: 27830 - protein, 9 aa, Artificial Sequence
  Description of Artificial Sequence: Synthetic peptide
  XENP021749 vlCDR3
QQYGSSPWT

SEQ ID NO: 27831 - protein, 214 aa, Artificial Sequence; identical to SEQ ID NO: 26297
  Description of Artificial Sequence: Synthetic polypeptide
  XENP021749 [anti-ICOS]_H0L0 _Fab-[anti-CTLA-4]_H3.23_L0.129_scFv Light Chain

SEQ ID NO: 27832 - protein, 107 aa, Artificial Sequence; identical to SEQ ID NO: 26298
  Description of Artificial Sequence: Synthetic polypeptide
  VL of XENP021749

SEQ ID NO: 27833 - protein, 11 aa, Artificial Sequence
  Description of Artificial Sequence: Synthetic peptide
  XENP021749 vlCDR1
RASQGISRLLA

SEQ ID NO: 27834 - protein, 7 aa, Artificial Sequence
  Description of Artificial Sequence: Synthetic peptide
  XENP021749 vlCDR2
VASSLQS

SEQ ID NO: 27835 - protein, 9 aa, Artificial Sequence
  Description of Artificial Sequence: Synthetic peptide
  XENP021749 vlCDR3
QQANSFPWT

SEQ ID NO: 27836 - protein, 452 aa, Artificial Sequence; identical to SEQ ID NO: 26682
  Description of Artificial Sequence: Synthetic polypeptide
  XENP021861 GSK_314.8[ICOS]_H0L0 one-arm mAb Fab-Fc Heavy Chain

SEQ ID NO: 27837 - protein, 123 aa, Artificial Sequence; identical to SEQ ID NO: 26303
  Description of Artificial Sequence: Synthetic polypeptide
  VH of XENP021861

SEQ ID NO: 27838 - protein, 5 aa, Artificial Sequence
  Description of Artificial Sequence: Synthetic peptide
  XENP021861 vhCDR1
TYWMH

SEQ ID NO: 27839 - protein, 17 aa, Artificial Sequence
  Description of Artificial Sequence: Synthetic peptide
  XENP021861 vhCDR2
EIDPSDSYVNYNQNFKG

SEQ ID NO: 27840 - protein, 14 aa, Artificial Sequence
  Description of Artificial Sequence: Synthetic peptide
  XENP021861 vhCDR3
SPDYYGTSLAWFDY

SEQ ID NO: 27841 - protein, 231 aa, Artificial Sequence; identical to SEQ ID NO: 27198
  Description of Artificial Sequence: Synthetic polypeptide
  XENP021861 GSK_314.8[ICOS]_H0L0 one-arm mAb Fc-only Heavy Chain

SEQ ID NO: 27842 - protein, 219 aa, Artificial Sequence; identical to SEQ ID NO: 26307
  Description of Artificial Sequence: Synthetic polypeptide
  XENP021861 GSK_314.8[ICOS]_H0L0 one-arm mAb Light Chain

SEQ ID NO: 27843 - protein, 112 aa, Artificial Sequence; identical to SEQ ID NO: 26308
  Description of Artificial Sequence: Synthetic polypeptide
  VL of XENP021861

SEQ ID NO: 27844 - protein, 16 aa, Artificial Sequence
  Description of Artificial Sequence: Synthetic peptide
  XENP021861 vlCDR1
RSSKSPLHSNGNIYLY

SEQ ID NO: 27845 - protein, 7 aa, Artificial Sequence
  Description of Artificial Sequence: Synthetic peptide
  XENP021861 vlCDR2
RMSNLAS

SEQ ID NO: 27846 - protein, 9 aa, Artificial Sequence
  Description of Artificial Sequence: Synthetic peptide
  XENP021861 vlCDR3
MQHLEYPYT

SEQ ID NO: 27847 - protein, 454 aa, Artificial Sequence; identical to SEQ ID NO: 26722
  Description of Artificial Sequence: Synthetic polypeptide
  XENP021863 jMab-138[ICOS]_H0L0 one-arm mAb Fab-Fc Heavy Chain

SEQ ID NO: 27848 - protein, 125 aa, Artificial Sequence; identical to SEQ ID NO: 26323
  Description of Artificial Sequence: Synthetic polypeptide
  VH of XENP021863

SEQ ID NO: 27849 - protein, 5 aa, Artificial Sequence
  Description of Artificial Sequence: Synthetic peptide
  XENP021863 vhCDR1
SYDMH

SEQ ID NO: 27850 - protein, 16 aa, Artificial Sequence
  Description of Artificial Sequence: Synthetic peptide
  XENP021863 vhCDR2
AIGTAGDTYYPGSVKG

SEQ ID NO: 27851 - protein, 17 aa, Artificial Sequence
  Description of Artificial Sequence: Synthetic peptide
  XENP021863 vhCDR3
DNRKVTHEHYYYYGMDV

SEQ ID NO: 27852 - protein, 231 aa, Artificial Sequence; identical to SEQ ID NO: 27198
  Description of Artificial Sequence: Synthetic polypeptide
  XENP021863 jMab-138[ICOS]_H0L0 one-arm mAb Fc-only Heavy Chain

SEQ ID NO: 27853 - protein, 216 aa, Artificial Sequence; identical to SEQ ID NO: 26327
  Description of Artificial Sequence: Synthetic polypeptide
  XENP021863 jMab-138[ICOS]_H0L0 one-arm mAb Light Chain

SEQ ID NO: 27854 - protein, 109 aa, Artificial Sequence; identical to SEQ ID NO: 26328
  Description of Artificial Sequence: Synthetic polypeptide
  VL of XENP021863

SEQ ID NO: 27855 - protein, 12 aa, Artificial Sequence
  Description of Artificial Sequence: Synthetic peptide
  XENP021863 vlCDR1
RASQNIRSSYLA

SEQ ID NO: 27856 - protein, 7 aa, Artificial Sequence
  Description of Artificial Sequence: Synthetic peptide
  XENP021863 vlCDR2
GASSRAT

SEQ ID NO: 27857 - protein, 10 aa, Artificial Sequence
  Description of Artificial Sequence: Synthetic peptide
  XENP021863 vlCDR3
QQFGSSPMCS

SEQ ID NO: 27858 - protein, 450 aa, Artificial Sequence; identical to SEQ ID NO: 26762
  Description of Artificial Sequence: Synthetic polypeptide
  XENP022349 WO2016059602[ICOS]_GSK_H0L0 one-arm mAb Fab-Fc Heavy Chain

SEQ ID NO: 27859 - protein, 121 aa, Artificial Sequence; identical to SEQ ID NO: 26343
  Description of Artificial Sequence: Synthetic polypeptide
  VH of XENP022349

SEQ ID NO: 27860 - protein, 5 aa, Artificial Sequence
  Description of Artificial Sequence: Synthetic peptide
  XENP022349 vhCDR1
DYAMH

SEQ ID NO: 27861 - protein, 17 aa, Artificial Sequence
  Description of Artificial Sequence: Synthetic peptide
  XENP022349 vhCDR2
LISIYSDHTNYNQKFQG

SEQ ID NO: 27862 - protein, 12 aa, Artificial Sequence
  Description of Artificial Sequence: Synthetic peptide
  XENP022349 vhCDR3
NNYGNYGWYFDV

SEQ ID NO: 27863 - protein, 231 aa, Artificial Sequence; identical to SEQ ID NO: 27198
  Description of Artificial Sequence: Synthetic polypeptide
  XENP022349 WO2016059602[ICOS]_GSK_H0L0 one-arm mAb Fc-only Heavy Chain

SEQ ID NO: 27864 - protein, 213 aa, Artificial Sequence; identical to SEQ ID NO: 26347
  Description of Artificial Sequence: Synthetic polypeptide
  XENP022349 WO2016059602[ICOS]_GSK_H0L0 one-arm mAb Light Chain

SEQ ID NO: 27865 - protein, 106 aa, Artificial Sequence; identical to SEQ ID NO: 26348
  Description of Artificial Sequence: Synthetic polypeptide
  VL of XENP022349

SEQ ID NO: 27866 - protein, 10 aa, Artificial Sequence
  Description of Artificial Sequence: Synthetic peptide
  XENP022349 vlCDR1
SASSSVSYMH

SEQ ID NO: 27867 - protein, 7 aa, Artificial Sequence
  Description of Artificial Sequence: Synthetic peptide
  XENP022349 vlCDR2
DTSKLAS

SEQ ID NO: 27868 - protein, 9 aa, Artificial Sequence
  Description of Artificial Sequence: Synthetic peptide
  XENP022349 vlCDR3
FQGSGYPYT

SEQ ID NO: 27869 - protein, 230 aa, Artificial Sequence
  Description of Artificial Sequence: Synthetic polypeptide
  XENP022050 [ICOS]_H0L0 _Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27870 - protein, 214 aa, Artificial Sequence; identical to SEQ ID NO: 26297
  Description of Artificial Sequence: Synthetic polypeptide
  XENP022050 [ICOS]_H0L0 _Fab_His Light Chain

SEQ ID NO: 27871 - protein, 230 aa, Artificial Sequence
  Description of Artificial Sequence: Synthetic polypeptide
  XENP022051 [ICOS]_H0.1_L0_Fab_His Heavy Chain
QVQLVQSGAEVKKPGASVKVSCKASGYTFTEYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27872 - protein, 214 aa, Artificial Sequence; identical to SEQ ID NO: 26297
  Description of Artificial Sequence: Synthetic polypeptide
  XENP022051 [ICOS]_H0.1_L0_Fab_His Light Chain

SEQ ID NO: 27873 - protein, 230 aa, Artificial Sequence
  Description of Artificial Sequence: Synthetic polypeptide
  XENP022052 [ICOS]_H0.2_L0_Fab_His Heavy Chain
QVQLVQSGAEVKKPGASVKVSCKASGYTFTSYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27874 - protein, 214 aa, Artificial Sequence; identical to SEQ ID NO: 26297
  Description of Artificial Sequence: Synthetic polypeptide
  XENP022052 [ICOS]_H0.2_L0_Fab_His Light Chain

SEQ ID NO: 27875 - protein, 230 aa, Artificial Sequence
  Description of Artificial Sequence: Synthetic polypeptide
  XENP022053 [ICOS]_H0.3_L0_Fab_His Heavy Chain
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27876 - protein, 214 aa, Artificial Sequence; identical to SEQ ID NO: 26297
  Description of Artificial Sequence: Synthetic polypeptide
  XENP022053 [ICOS]_H0.3_L0_Fab_His Light Chain

SEQ ID NO: 27877 - protein, 230 aa, Artificial Sequence
  Description of Artificial Sequence: Synthetic polypeptide
  XENP022054 [ICOS]_H0.4_L0_Fab_His Heavy Chain
QVQLVQSGAEVKKPGASVKVSCKASGYTFTGYYMHWVRQAPGQGLEWMGWINPESGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27878 - protein, 214 aa, Artificial Sequence; identical to SEQ ID NO: 26297
  Description of Artificial Sequence: Synthetic polypeptide
  XENP022054 [ICOS]_H0.4_L0_Fab_His Light Chain

SEQ ID NO: 27879 - protein, 230 aa, Artificial Sequence
  Description of Artificial Sequence: Synthetic polypeptide
  XENP022055 [ICOS]_H0.5_L0_Fab_His Heavy Chain
QVQLVQSGAEVKKPGASVKVSCKASGYTFTGYYMHWVRQAPGQGLEWMGWINPSSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27880 - protein, 214 aa, Artificial Sequence; identical to SEQ ID NO: 26297
  Description of Artificial Sequence: Synthetic polypeptide
  XENP022055 [ICOS]_H0.5_L0_Fab_His Light Chain

SEQ ID NO: 27881 - protein, 230 aa, Artificial Sequence
  Description of Artificial Sequence: Synthetic polypeptide
  XENP022056 [ICOS]_H0.6_L0_Fab_His Heavy Chain
QVQLVQSGAEVKKPGASVKVSCKASGYTFTGYYMHWVRQAPGQGLEWMGWINPHGGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27882 - protein, 214 aa, Artificial Sequence; identical to SEQ ID NO: 26297
  Description of Artificial Sequence: Synthetic polypeptide
  XENP022056 [ICOS]_H0.6_L0_Fab_His Light Chain

SEQ ID NO: 27883 - protein, 230 aa, Artificial Sequence
  Description of Artificial Sequence: Synthetic polypeptide
  XENP022057 [ICOS]_H0.7_L0_Fab_His Heavy Chain
QVQLVQSGAEVKKPGASVKVSCKASGYTFTGYYMHWVRQAPGQGLEWMGWINPHSGETNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27884 - protein, 214 aa, Artificial Sequence; identical to SEQ ID NO: 26297
  Description of Artificial Sequence: Synthetic polypeptide
  XENP022057 [ICOS]_H0.7_L0_Fab_His Light Chain

SEQ ID NO: 27885 - protein, 230 aa, Artificial Sequence
  Description of Artificial Sequence: Synthetic polypeptide
  XENP022058 [ICOS]_H0.8_L0_Fab_His Heavy Chain
QVQLVQSGAEVKKPGASVKVSCKASGYTFTGYYMHWVRQAPGQGLEWMGWINPHSGGTSYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27886 - protein, 214 aa, Artificial Sequence; identical to SEQ ID NO: 26297
  Description of Artificial Sequence: Synthetic polypeptide
  XENP022058 [ICOS]_H0.8_L0_Fab_His Light Chain

SEQ ID NO: 27887 - protein, 230 aa, Artificial Sequence
  Description of Artificial Sequence: Synthetic polypeptide
  XENP022059 [ICOS]_H0.9_L0_Fab_His Heavy Chain
QVQLVQSGAEVKKPGASVKVSCKASGYTFTGYYMHWVRQAPGQGLEWMGWINPHSGGTNYAEKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27888 - protein, 214 aa, Artificial Sequence; identical to SEQ ID NO: 26297
  Description of Artificial Sequence: Synthetic polypeptide
  XENP022059 [ICOS]_H0.9_L0_Fab_His Light Chain

SEQ ID NO: 27889 - protein, 230 aa, Artificial Sequence
  Description of Artificial Sequence: Synthetic polypeptide
  XENP022060 [ICOS]_H0.10_L0_Fab_His Heavy Chain
QVQLVQSGAEVKKPGASVKVSCKASGYTFTGYYMHWVRQAPGQGLEWMGWINPHSGGTNYAQKFQERVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27890 - protein, 214 aa, Artificial Sequence; identical to SEQ ID NO: 26297
  Description of Artificial Sequence: Synthetic polypeptide
  XENP022060 [ICOS]_H0.10_L0_Fab_His Light Chain

SEQ ID NO: 27891 - protein, 230 aa, Artificial Sequence
  Description of Artificial Sequence: Synthetic polypeptide
  XENP022061 [ICOS]_H0.11_L0_Fab_His Heavy Chain
QVQLVQSGAEVKKPGASVKVSCKASGYTFTGYYMHWVRQAPGQGLEWMGWINPHSGGTNYAQKFQGRVTITRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27892 - protein, 214 aa, Artificial Sequence; identical to SEQ ID NO: 26297
  Description of Artificial Sequence: Synthetic polypeptide
  XENP022061 [ICOS]_H0.11_L0_Fab_His Light Chain

SEQ ID NO: 27893 - protein, 230 aa, Artificial Sequence
  Description of Artificial Sequence: Synthetic polypeptide
  XENP022062 [ICOS]_H0.12_L0_Fab_His Heavy Chain
QVQLVQSGAEVKKPGASVKVSCKASGYTFTGYYMHWVRQAPGQGLEWMGWINPHSGGTNYAQKFQGRVTMTADTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27894 - protein, 214 aa, Artificial Sequence; identical to SEQ ID NO: 26297
  Description of Artificial Sequence: Synthetic polypeptide
  XENP022062 [ICOS]_H0.12_L0_Fab_His Light Chain

SEQ ID NO: 27895 - protein, 230 aa, Artificial Sequence
  Description of Artificial Sequence: Synthetic polypeptide
  XENP022063 [ICOS]_H0.13_L0_Fab_His Heavy Chain
QVQLVQSGAEVKKPGASVKVSCKASGYTFTGYYMHWVRQAPGQGLEWMGWINPHSGGTNYAQKFQGRVTMTEDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27896 - protein, 214 aa, Artificial Sequence; identical to SEQ ID NO: 26297
  Description of Artificial Sequence: Synthetic polypeptide
  XENP022063 [ICOS]_H0.13_L0_Fab_His Light Chain

SEQ ID NO: 27897 - protein, 230 aa, Artificial Sequence
  Description of Artificial Sequence: Synthetic polypeptide
  XENP022064 [ICOS]_H0.14_L0_Fab_His Heavy Chain
QVQLVQSGAEVKKPGASVKVSCKASGYTFTGYYMHWVRQAPGQGLEWMGWINPHSGGTNYAQKFQGRVTMTTDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27898 - protein, 214 aa, Artificial Sequence; identical to SEQ ID NO: 26297
  Description of Artificial Sequence: Synthetic polypeptide
  XENP022064 [ICOS]_H0.14_L0_Fab_His Light Chain

SEQ ID NO: 27899 - protein, 230 aa, Artificial Sequence
  Description of Artificial Sequence: Synthetic polypeptide
  XENP022065 [ICOS]_H0.15_L0_Fab_His Heavy Chain
QVQLVQSGAEVKKPGASVKVSCKASGYTFTGYYMHWVRQAPGQGLEWMGWINPHSGGTNYAQKFQGRVTMTRDESISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27900 - protein, 214 aa, Artificial Sequence; identical to SEQ ID NO: 26297
  Description of Artificial Sequence: Synthetic polypeptide
  XENP022065 [ICOS]_H0.15_L0_Fab_His Light Chain

SEQ ID NO: 27901 - protein, 230 aa, Artificial Sequence
  Description of Artificial Sequence: Synthetic polypeptide
  XENP022066 [ICOS]_H0.16_L0_Fab_His Heavy Chain
QVQLVQSGAEVKKPGASVKVSCKASGYTFTGYYMHWVRQAPGQGLEWMGWINPHSGGTNYAQKFQGRVTMTRDTSTSTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27902 - protein, 214 aa, Artificial Sequence; identical to SEQ ID NO: 26297
  Description of Artificial Sequence: Synthetic polypeptide
  XENP022066 [ICOS]_H0.16_L0_Fab_His Light Chain

SEQ ID NO: 27903 - protein, 230 aa, Artificial Sequence
  Description of Artificial Sequence: Synthetic polypeptide
  XENP022067 [ICOS]_H0.17_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSSLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27904 - protein, 214 aa, Artificial Sequence; identical to SEQ ID NO: 26297
  Description of Artificial Sequence: Synthetic polypeptide
  XENP022067 [ICOS]_H0.17_L0_Fab_His Light Chain

SEQ ID NO: 27905 - protein, 230 aa, Artificial Sequence
  Description of Artificial Sequence: Synthetic polypeptide
  XENP022068 [ICOS]_H0.18_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSEDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27906 - protein, 214 aa, Artificial Sequence; identical to SEQ ID NO: 26297
  Description of Artificial Sequence: Synthetic polypeptide
  XENP022068 [ICOS]_H0.18_L0_Fab_His Light Chain

SEQ ID NO: 27907 - protein, 230 aa, Artificial Sequence
  Description of Artificial Sequence: Synthetic polypeptide
  XENP022069 [ICOS]_H0.19_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYASSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27908 - protein, 214 aa, Artificial Sequence; identical to SEQ ID NO: 26297
  Description of Artificial Sequence: Synthetic polypeptide
  XENP022069 [ICOS]_H0.19_L0_Fab_His Light Chain

SEQ ID NO: 27909 - protein, 230 aa, Artificial Sequence
  Description of Artificial Sequence: Synthetic polypeptide
  XENP022070 [ICOS]_H0.20_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYESSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27910 - protein, 214 aa, Artificial Sequence; identical to SEQ ID NO: 26297
  Description of Artificial Sequence: Synthetic polypeptide
  XENP022070 [ICOS]_H0.20_L0_Fab_His Light Chain

SEQ ID NO: 27911 - protein, 230 aa, Artificial Sequence
  Description of Artificial Sequence: Synthetic polypeptide
  XENP022071 [ICOS]_H0.21_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYQSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27912 - protein, 214 aa, Artificial Sequence; identical to SEQ ID NO: 26297
  Description of Artificial Sequence: Synthetic polypeptide
  XENP022071 [ICOS]_H0.21_L0_Fab_His Light Chain

SEQ ID NO: 27913 - protein, 230 aa, Artificial Sequence
  Description of Artificial Sequence: Synthetic polypeptide
  XENP022072 [ICOS]_H0.22_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYSSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27914 - protein, 214 aa, Artificial Sequence; identical to SEQ ID NO: 26297
  Description of Artificial Sequence: Synthetic polypeptide
  XENP022072 [ICOS]_H0.22_L0_Fab_His Light Chain

SEQ ID NO: 27915 - protein, 230 aa, Artificial Sequence
  Description of Artificial Sequence: Synthetic polypeptide
  XENP022073 [ICOS]_H0.23_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYTSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27916 - protein, 214 aa, Artificial Sequence; identical to SEQ ID NO: 26297
  Description of Artificial Sequence: Synthetic polypeptide
  XENP022073 [ICOS]_H0.23_L0_Fab_His Light Chain

SEQ ID NO: 27917 - protein, 230 aa, Artificial Sequence
  Description of Artificial Sequence: Synthetic polypeptide
  XENP022074 [ICOS]_H0.24_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27918 - protein, 214 aa, Artificial Sequence; identical to SEQ ID NO: 26297
  Description of Artificial Sequence: Synthetic polypeptide
  XENP022074 [ICOS]_H0.24_L0_Fab_His Light Chain

SEQ ID NO: 27919 - protein, 230 aa, Artificial Sequence
  Description of Artificial Sequence: Synthetic polypeptide
  XENP022075 [ICOS]_H0.25_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYEDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27920 - protein, 214 aa, Artificial Sequence; identical to SEQ ID NO: 26297
  Description of Artificial Sequence: Synthetic polypeptide
  XENP022075 [ICOS]_H0.25_L0_Fab_His Light Chain

SEQ ID NO: 27921 - protein, 230 aa, Artificial Sequence
  Description of Artificial Sequence: Synthetic polypeptide
  XENP022076 [ICOS]_H0.26_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYQDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27922 - protein, 214 aa, Artificial Sequence; identical to SEQ ID NO: 26297
  Description of Artificial Sequence: Synthetic polypeptide
  XENP022076 [ICOS]_H0.26_L0_Fab_His Light Chain

SEQ ID NO: 27923 - protein, 230 aa, Artificial Sequence
  Description of Artificial Sequence: Synthetic polypeptide
  XENP022077 [ICOS]_H0.27_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYSDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27924 - protein, 214 aa, Artificial Sequence; identical to SEQ ID NO: 26297
  Description of Artificial Sequence: Synthetic polypeptide
  XENP022077 [ICOS]_H0.27_L0_Fab_His Light Chain

SEQ ID NO: 27925 - protein, 230 aa, Artificial Sequence
  Description of Artificial Sequence: Synthetic polypeptide
  XENP022078 [ICOS]_H0.28_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYYDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27926 - protein, 214 aa, Artificial Sequence; identical to SEQ ID NO: 26297
  Description of Artificial Sequence: Synthetic polypeptide
  XENP022078 [ICOS]_H0.28_L0_Fab_His Light Chain

SEQ ID NO: 27927 - protein, 230 aa, Artificial Sequence
  Description of Artificial Sequence: Synthetic polypeptide
  XENP022079 [ICOS]_H0.29_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHAAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27928 - protein, 214 aa, Artificial Sequence; identical to SEQ ID NO: 26297
  Description of Artificial Sequence: Synthetic polypeptide
  XENP022079 [ICOS]_H0.29_L0_Fab_His Light Chain

SEQ ID NO: 27929 - protein, 230 aa, Artificial Sequence
  Description of Artificial Sequence: Synthetic polypeptide
  XENP022080 [ICOS]_H0.30_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHEAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27930 - protein, 214 aa, Artificial Sequence; identical to SEQ ID NO: 26297
  Description of Artificial Sequence: Synthetic polypeptide
  XENP022080 [ICOS]_H0.30_L0_Fab_His Light Chain

SEQ ID NO: 27931 - protein, 230 aa, Artificial Sequence
  Description of Artificial Sequence: Synthetic polypeptide
  XENP022081 [ICOS]_H0.31_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHQAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27932 - protein, 214 aa, Artificial Sequence; identical to SEQ ID NO: 26297
  Description of Artificial Sequence: Synthetic polypeptide
  XENP022081 [ICOS]_H0.31_L0_Fab_His Light Chain

SEQ ID NO: 27933 - protein, 230 aa, Artificial Sequence
  Description of Artificial Sequence: Synthetic polypeptide
  XENP022082 [ICOS]_H0.32_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHSAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27934 - protein, 214 aa, Artificial Sequence; identical to SEQ ID NO: 26297
  Description of Artificial Sequence: Synthetic polypeptide
  XENP022082 [ICOS]_H0.32_L0_Fab_His Light Chain

SEQ ID NO: 27935 - protein, 230 aa, Artificial Sequence
  Description of Artificial Sequence: Synthetic polypeptide
  XENP022083 [ICOS]_H0.33_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHTAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27936 - protein, 214 aa, Artificial Sequence; identical to SEQ ID NO: 26297
  Description of Artificial Sequence: Synthetic polypeptide
  XENP022083 [ICOS]_H0.33_L0_Fab_His Light Chain

SEQ ID NO: 27937 - protein, 230 aa, Artificial Sequence
  Description of Artificial Sequence: Synthetic polypeptide
  XENP022084 [ICOS]_H0.34_L0_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 27938 - protein, 214 aa, Artificial Sequence; identical to SEQ ID NO: 26297
  Description of Artificial Sequence: Synthetic polypeptide
  XENP022084 [ICOS]_H0.34_L0_Fab_His Light Chain

SEQ ID NO: 27939 - protein, 230 aa, Artificial Sequence; identical to SEQ ID NO: 27869
  Description of Artificial Sequence: Synthetic polypeptide
  XENP022085 [ICOS]_H0_L0.1_Fab_His Heavy Chain

SEQ ID NO: 27940 - protein, 214 aa, Artificial Sequence
  Description of Artificial Sequence: Synthetic polypeptide
  XENP022085 [ICOS]_H0_L0.1_Fab_His Light Chain
DIQMTQSPSSLSASVGDRVTITCRASQGISRLLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27941 - protein, 230 aa, Artificial Sequence; identical to SEQ ID NO: 27869
  Description of Artificial Sequence: Synthetic polypeptide
  XENP022086 [ICOS]_H0_L0.2_Fab_His Heavy Chain

SEQ ID NO: 27942 - protein, 214 aa, Artificial Sequence
  Description of Artificial Sequence: Synthetic polypeptide
  XENP022086 [ICOS]_H0_L0.2_Fab_His Light Chain
DIQMTQSPSSVSASVGDRVTITCQASQGISRLLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27943 - protein, 230 aa, Artificial Sequence; identical to SEQ ID NO: 27869
  Description of Artificial Sequence: Synthetic polypeptide
  XENP022087 [ICOS]_H0_L0.3_Fab_His Heavy Chain

SEQ ID NO: 27944 - protein, 214 aa, Artificial Sequence
  Description of Artificial Sequence: Synthetic polypeptide
  XENP022087 [ICOS]_H0_L0.3_Fab_His Light Chain
DIQMTQSPSSVSASVGDRVTITCRASQDISRLLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27945 - protein, 230 aa, Artificial Sequence; identical to SEQ ID NO: 27869
  Description of Artificial Sequence: Synthetic polypeptide
  XENP022088 [ICOS]_H0_L0.4_Fab_His Heavy Chain

SEQ ID NO: 27946 - protein, 214 aa, Artificial Sequence
  Description of Artificial Sequence: Synthetic polypeptide
  XENP022088 [ICOS]_H0_L0.4_Fab_His Light Chain
DIQMTQSPSSVSASVGDRVTITCRASQSISRLLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27947 - protein, 230 aa, Artificial Sequence; identical to SEQ ID NO: 27869
  Description of Artificial Sequence: Synthetic polypeptide
  XENP022089 [ICOS]_H0_L0.5_Fab_His Heavy Chain

SEQ ID NO: 27948 - protein, 214 aa, Artificial Sequence; identical to SEQ ID NO: 27243
  Description of Artificial Sequence: Synthetic polypeptide
  XENP022089 [ICOS]_H0_L0.5_Fab_His Light Chain

SEQ ID NO: 27949 - protein, 230 aa, Artificial Sequence; identical to SEQ ID NO: 27869
  Description of Artificial Sequence: Synthetic polypeptide
  XENP022090 [ICOS]_H0_L0.6_Fab_His Heavy Chain

SEQ ID NO: 27950 - protein, 214 aa, Artificial Sequence
  Description of Artificial Sequence: Synthetic polypeptide
  XENP022090 [ICOS]_H0_L0.6_Fab_His Light Chain
DIQMTQSPSSVSASVGDRVTITCRASQGISSWLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27951 - protein, 230 aa, Artificial Sequence; identical to SEQ ID NO: 27869
  Description of Artificial Sequence: Synthetic polypeptide
  XENP022091 [ICOS]_H0_L0.7_Fab_His Heavy Chain

SEQ ID NO: 27952 - protein, 214 aa, Artificial Sequence; identical to SEQ ID NO: 26477
  Description of Artificial Sequence: Synthetic polypeptide
  XENP022091 [ICOS]_H0_L0.7_Fab_His Light Chain

SEQ ID NO: 27953 - protein, 230 aa, Artificial Sequence; identical to SEQ ID NO: 27869
  Description of Artificial Sequence: Synthetic polypeptide
  XENP022092 [ICOS]_H0_L0.8_Fab_His Heavy Chain

SEQ ID NO: 27954 - protein, 214 aa, Artificial Sequence
  Description of Artificial Sequence: Synthetic polypeptide
  XENP022092 [ICOS]_H0_L0.8_Fab_His Light Chain
DIQMTQSPSSVSASVGDRVTITCRASQGISRWLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27955 - protein, 230 aa, Artificial Sequence; identical to SEQ ID NO: 27869
  Description of Artificial Sequence: Synthetic polypeptide
  XENP022093 [ICOS]_H0_L0.9_Fab_His Heavy Chain

SEQ ID NO: 27956 - protein, 214 aa, Artificial Sequence; identical to SEQ ID NO: 27265
  Description of Artificial Sequence: Synthetic polypeptide
  XENP022093 [ICOS]_H0_L0.9_Fab_His Light Chain

SEQ ID NO: 27957 - protein, 230 aa, Artificial Sequence; identical to SEQ ID NO: 27869
  Description of Artificial Sequence: Synthetic polypeptide
  XENP022094 [ICOS]_H0_L0.10_Fab_His Heavy Chain

SEQ ID NO: 27958 - protein, 214 aa, Artificial Sequence; identical to SEQ ID NO: 27276
  Description of Artificial Sequence: Synthetic polypeptide
  XENP022094 [ICOS]_H0_L0.10_Fab_His Light Chain

SEQ ID NO: 27959 - protein, 230 aa, Artificial Sequence; identical to SEQ ID NO: 27869
  Description of Artificial Sequence: Synthetic polypeptide
  XENP022095 [ICOS]_H0_L0.11_Fab_His Heavy Chain

SEQ ID NO: 27960 - protein, 214 aa, Artificial Sequence
  Description of Artificial Sequence: Synthetic polypeptide
  XENP022095 [ICOS]_H0_L0.11_Fab_His Light Chain
DIQMTQSPSSVSASVGDRVTITCRASQGISRLLAWYQQKPGKAPKLLIYSASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27961 - protein, 230 aa, Artificial Sequence; identical to SEQ ID NO: 27869
  Description of Artificial Sequence: Synthetic polypeptide
  XENP022096 [ICOS]_H0_L0.12_Fab_His Heavy Chain

SEQ ID NO: 27962 - protein, 214 aa, Artificial Sequence
  Description of Artificial Sequence: Synthetic polypeptide
  XENP022096 [ICOS]_H0_L0.12_Fab_His Light Chain
DIQMTQSPSSVSASVGDRVTITCRASQGISRLLAWYQQKPGKAPKLLIYVASTLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27963 - protein, 230 aa, Artificial Sequence; identical to SEQ ID NO: 27869
  Description of Artificial Sequence: Synthetic polypeptide
  XENP022101 [ICOS]_H0_L0.13_Fab_His Heavy Chain

SEQ ID NO: 27964 - protein, 214 aa, Artificial Sequence
  Description of Artificial Sequence: Synthetic polypeptide
  XENP022101 [ICOS]_H0_L0.13_Fab_His Light Chain
DIQMTQSPSSVSASVGDRVTITCRASQGISRLLAWYQQKPGKAPKLLIYVASSLESGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27965 - protein, 230 aa, Artificial Sequence; identical to SEQ ID NO: 27869
  Description of Artificial Sequence: Synthetic polypeptide
  XENP022102 [ICOS]_H0_L0.14_Fab_His Heavy Chain

SEQ ID NO: 27966 - protein, 214 aa, Artificial Sequence; identical to SEQ ID NO: 27287
  Description of Artificial Sequence: Synthetic polypeptide
  XENP022102 [ICOS]_H0_L0.14_Fab_His Light Chain

SEQ ID NO: 27967 - protein, 230 aa, Artificial Sequence; identical to SEQ ID NO: 27869
  Description of Artificial Sequence: Synthetic polypeptide
  XENP022103 [ICOS]_H0_L0.15_Fab_His Heavy Chain

SEQ ID NO: 27968 - protein, 214 aa, Artificial Sequence; identical to SEQ ID NO: 27298
  Description of Artificial Sequence: Synthetic polypeptide
  XENP022103 [ICOS]_H0_L0.15_Fab_His Light Chain

SEQ ID NO: 27969 - protein, 230 aa, Artificial Sequence; identical to SEQ ID NO: 27869
  Description of Artificial Sequence: Synthetic polypeptide
  XENP022104 [ICOS]_H0_L0.16_Fab_His Heavy Chain

SEQ ID NO: 27970 - protein, 214 aa, Artificial Sequence
  Description of Artificial Sequence: Synthetic polypeptide
  XENP022104 [ICOS]_H0_L0.16_Fab_His Light Chain
DIQMTQSPSSVSASVGDRVTITCRASQGISRLLAWYQQKPGKAPKLLIYVASSLQSGVPSRFSGSGSGTDFTLTISSLQPEDFATYYCQQAQSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27971 - protein, 230 aa, Artificial Sequence; identical to SEQ ID NO: 27869
  Description of Artificial Sequence: Synthetic polypeptide
  XENP022105 [ICOS]_H0_L0.17_Fab_His Heavy Chain

SEQ ID NO: 27972 - protein, 214 aa, Artificial Sequence
  Description of Artificial Sequence: Synthetic polypeptide
  XENP022105 [ICOS]_H0_L0.17_Fab_His Light Chain
DIQMTQSPSSVSASVGDRVTITCRASQGISRLLAWYQQKPGKAPKLLIYVASSLQSGVPSRFSGSGSGTDFTLTISSLQPEDFATYYCQQAYSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27973 - protein, 230 aa, Artificial Sequence; identical to SEQ ID NO: 27869
  Description of Artificial Sequence: Synthetic polypeptide
  XENP022106 [ICOS]_H0_L0.18_Fab_His Heavy Chain

SEQ ID NO: 27974 - protein, 214 aa, Artificial Sequence
  Description of Artificial Sequence: Synthetic polypeptide
  XENP022106 [ICOS]_H0_L0.18_Fab_His Light Chain
DIQMTQSPSSVSASVGDRVTITCRASQGISRLLAWYQQKPGKAPKLLIYVASSLQSGVPSRFSGSGSGTDFTLTISSLQPEDFATYYCQQANTFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27975 - protein, 230 aa, Artificial Sequence; identical to SEQ ID NO: 27869
  Description of Artificial Sequence: Synthetic polypeptide
  XENP022107 [ICOS]_H0_L0.19_Fab_His Heavy Chain

SEQ ID NO: 27976 - protein, 214 aa, Artificial Sequence
  Description of Artificial Sequence: Synthetic polypeptide
  XENP022107 [ICOS]_H0_L0.19_Fab_His Light Chain
DIQMTQSPSSVSASVGDRVTITCRASQGISRLLAWYQQKPGKAPKLLIYVASSLQSGVPSRFSGSGSGTDFTLTISSLQPEDFATYYCQQANSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27977 - protein, 230 aa, Artificial Sequence; identical to SEQ ID NO: 27869
  Description of Artificial Sequence: Synthetic polypeptide
  XENP022108 [ICOS]_H0_L0.20_Fab_His Heavy Chain

SEQ ID NO: 27978 - protein, 214 aa, Artificial Sequence; identical to SEQ ID NO: 27309
  Description of Artificial Sequence: Synthetic polypeptide
  XENP022108 [ICOS]_H0_L0.20_Fab_His Light Chain

SEQ ID NO: 27979 - protein, 230 aa, Artificial Sequence; identical to SEQ ID NO: 27869
  Description of Artificial Sequence: Synthetic polypeptide
  XENP022767 [ICOS]_H0_L0.21_Fab_His Heavy Chain

SEQ ID NO: 27980 - protein, 214 aa, Artificial Sequence
  Description of Artificial Sequence: Synthetic polypeptide
  XENP022767 [ICOS]_H0_L0.21_Fab_His Light Chain
DIQMTQSPSSVSASVGDRVTITCRASQDISSLLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27981 - protein, 230 aa, Artificial Sequence; identical to SEQ ID NO: 27869
  Description of Artificial Sequence: Synthetic polypeptide
  XENP022768 [ICOS]_H0_L0.22_Fab_His Heavy Chain

SEQ ID NO: 27982 - protein, 214 aa, Artificial Sequence
  Description of Artificial Sequence: Synthetic polypeptide
  XENP022768 [ICOS]_H0_L0.22_Fab_His Light Chain
DIQMTQSPSSVSASVGDRVTITCRASQDISRLLAWYQQKPGKAPKLLIYAASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27983 - protein, 230 aa, Artificial Sequence; identical to SEQ ID NO: 27869
  Description of Artificial Sequence: Synthetic polypeptide
  XENP022769 [ICOS]_H0_L0.23_Fab_His Heavy Chain

SEQ ID NO: 27984 - protein, 214 aa, Artificial Sequence
  Description of Artificial Sequence: Synthetic polypeptide
  XENP022769 [ICOS]_H0_L0.23_Fab_His Light Chain
DIQMTQSPSSVSASVGDRVTITCRASQDISRLLAWYQQKPGKAPKLLIYVASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27985 - protein, 230 aa, Artificial Sequence; identical to SEQ ID NO: 27869
  Description of Artificial Sequence: Synthetic polypeptide
  XENP022770 [ICOS]_H0_L0.24_Fab_His Heavy Chain

SEQ ID NO: 27986 - protein, 214 aa, Artificial Sequence
  Description of Artificial Sequence: Synthetic polypeptide
  XENP022770 [ICOS]_H0_L0.24_Fab_His Light Chain
DIQMTQSPSSVSASVGDRVTITCRASQGISSLLAWYQQKPGKAPKLLIYAASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27987 - protein, 230 aa, Artificial Sequence; identical to SEQ ID NO: 27869
  Description of Artificial Sequence: Synthetic polypeptide
  XENP022771 [ICOS]_H0_L0.25_Fab_His Heavy Chain

SEQ ID NO: 27988 - protein, 214 aa, Artificial Sequence
  Description of Artificial Sequence: Synthetic polypeptide
  XENP022771 [ICOS]_H0_L0.25_Fab_His Light Chain
DIQMTQSPSSVSASVGDRVTITCRASQGISSLLAWYQQKPGKAPKLLIYVASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27989 - protein, 230 aa, Artificial Sequence; identical to SEQ ID NO: 27869
  Description of Artificial Sequence: Synthetic polypeptide
  XENP022772 [ICOS]_H0_L0.26_Fab_His Heavy Chain

SEQ ID NO: 27990 - protein, 214 aa, Artificial Sequence
  Description of Artificial Sequence: Synthetic polypeptide
  XENP022772 [ICOS]_H0_L0.26_Fab_His Light Chain
DIQMTQSPSSVSASVGDRVTITCRASQGISRLLAWYQQKPGKAPKLLIYAASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27991 - protein, 230 aa, Artificial Sequence; identical to SEQ ID NO: 27869
  Description of Artificial Sequence: Synthetic polypeptide
  XENP022773 [ICOS]_H0_L0.27_Fab_His Heavy Chain

SEQ ID NO: 27992 - protein, 214 aa, Artificial Sequence
  Description of Artificial Sequence: Synthetic polypeptide
  XENP022773 [ICOS]_H0_L0.27_Fab_His Light Chain
DIQMTQSPSSVSASVGDRVTITCRASQDISSLLAWYQQKPGKAPKLLIYAASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27993 - protein, 230 aa, Artificial Sequence; identical to SEQ ID NO: 27869
  Description of Artificial Sequence: Synthetic polypeptide
  XENP022774 [ICOS]_H0_L0.28_Fab_His Heavy Chain

SEQ ID NO: 27994 - protein, 214 aa, Artificial Sequence
  Description of Artificial Sequence: Synthetic polypeptide
  XENP022774 [ICOS]_H0_L0.28_Fab_His Light Chain
DIQMTQSPSSVSASVGDRVTITCRASQDISSLLAWYQQKPGKAPKLLIYVASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27995 - protein, 230 aa, Artificial Sequence; identical to SEQ ID NO: 27869
  Description of Artificial Sequence: Synthetic polypeptide
  XENP022775 [ICOS]_H0_L0.29_Fab_His Heavy Chain

SEQ ID NO: 27996 - protein, 214 aa, Artificial Sequence
  Description of Artificial Sequence: Synthetic polypeptide
  XENP022775 [ICOS]_H0_L0.29_Fab_His Light Chain
DIQMTQSPSSVSASVGDRVTITCRASQDISRLLAWYQQKPGKAPKLLIYAASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27997 - protein, 230 aa, Artificial Sequence; identical to SEQ ID NO: 27869
  Description of Artificial Sequence: Synthetic polypeptide
  XENP022776 [ICOS]_H0_L0.30_Fab_His Heavy Chain

SEQ ID NO: 27998 - protein, 214 aa, Artificial Sequence
  Description of Artificial Sequence: Synthetic polypeptide
  XENP022776 [ICOS]_H0_L0.30_Fab_His Light Chain
DIQMTQSPSSVSASVGDRVTITCRASQGISSLLAWYQQKPGKAPKLLIYAASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 27999 - protein, 230 aa, Artificial Sequence; identical to SEQ ID NO: 27869
  Description of Artificial Sequence: Synthetic polypeptide
  XENP022777 [ICOS]_H0_L0.31_Fab_His Heavy Chain

SEQ ID NO: 28000 - protein, 214 aa, Artificial Sequence
  Description of Artificial Sequence: Synthetic polypeptide
  XENP022777 [ICOS]_H0_L0.31_Fab_His Light Chain
DIQMTQSPSSVSASVGDRVTITCRASQDISSLLAWYQQKPGKAPKLLIYAASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28001 - protein, 230 aa, Artificial Sequence; identical to SEQ ID NO: 27869
  Description of Artificial Sequence: Synthetic polypeptide
  XENP022778 [ICOS]_H0_L0.32_Fab_His Heavy Chain

SEQ ID NO: 28002 - protein, 214 aa, Artificial Sequence
  Description of Artificial Sequence: Synthetic polypeptide
  XENP022778 [ICOS]_H0_L0.32_Fab_His Light Chain
DIQMTQSPSSVSASVGDRVTITCQASQDISSLLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28003 - protein, 230 aa, Artificial Sequence; identical to SEQ ID NO: 27869
  Description of Artificial Sequence: Synthetic polypeptide
  XENP022779 [ICOS]_H0_L0.33_Fab_His Heavy Chain

SEQ ID NO: 28004 - protein, 214 aa, Artificial Sequence
  Description of Artificial Sequence: Synthetic polypeptide
  XENP022779 [ICOS]_H0_L0.33_Fab_His Light Chain
DIQMTQSPSSVSASVGDRVTITCQASQDISRLLAWYQQKPGKAPKLLIYAASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28005 - protein, 230 aa, Artificial Sequence; identical to SEQ ID NO: 27869
  Description of Artificial Sequence: Synthetic polypeptide
  XENP022780 [ICOS]_H0_L0.34_Fab_His Heavy Chain

SEQ ID NO: 28006 - protein, 214 aa, Artificial Sequence; identical to SEQ ID NO: 26497
  Description of Artificial Sequence: Synthetic polypeptide
  XENP022780 [ICOS]_H0_L0.34_Fab_His Light Chain

SEQ ID NO: 28007 - protein, 230 aa, Artificial Sequence; identical to SEQ ID NO: 27869
  Description of Artificial Sequence: Synthetic polypeptide
  XENP022781 [ICOS]_H0_L0.35_Fab_His Heavy Chain

SEQ ID NO: 28008 - protein, 214 aa, Artificial Sequence
  Description of Artificial Sequence: Synthetic polypeptide
  XENP022781 [ICOS]_H0_L0.35_Fab_His Light Chain
DIQMTQSPSSVSASVGDRVTITCQASQDISSLLAWYQQKPGKAPKLLIYAASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28009 - protein, 230 aa, Artificial Sequence; identical to SEQ ID NO: 27869
  Description of Artificial Sequence: Synthetic polypeptide
  XENP022782 [ICOS]_H0_L0.36_Fab_His Heavy Chain

SEQ ID NO: 28010 - protein, 214 aa, Artificial Sequence; identical to SEQ ID NO: 26517
  Description of Artificial Sequence: Synthetic polypeptide
  XENP022782 [ICOS]_H0_L0.36_Fab_His Light Chain

SEQ ID NO: 28011 - protein, 230 aa, Artificial Sequence; identical to SEQ ID NO: 27869
  Description of Artificial Sequence: Synthetic polypeptide
  XENP022783 [ICOS]_H0_L0.37_Fab_His Heavy Chain

SEQ ID NO: 28012 - protein, 214 aa, Artificial Sequence; identical to SEQ ID NO: 26537
  Description of Artificial Sequence: Synthetic polypeptide
  XENP022783 [ICOS]_H0_L0.37_Fab_His Light Chain

SEQ ID NO: 28013 - protein, 230 aa, Artificial Sequence; identical to SEQ ID NO: 27869
  Description of Artificial Sequence: Synthetic polypeptide
  XENP022784 [ICOS]_H0_L0.38_Fab_His Heavy Chain

SEQ ID NO: 28014 - protein, 214 aa, Artificial Sequence; identical to SEQ ID NO: 26557
  Description of Artificial Sequence: Synthetic polypeptide
  XENP022784 [ICOS]_H0_L0.38_Fab_His Light Chain

SEQ ID NO: 28015 - protein, 230 aa, Artificial Sequence; identical to SEQ ID NO: 27869
  Description of Artificial Sequence: Synthetic polypeptide
  XENP022860 [ICOS]_H0_L0.42_Fab_His Heavy Chain

SEQ ID NO: 28016 - protein, 214 aa, Artificial Sequence
  Description of Artificial Sequence: Synthetic polypeptide
  XENP022860 [ICOS]_H0_L0.42_Fab_His Light Chain
DIQMTQSPSSVSASVGDRVTITCQASQDISSYLAWYQQKPGKAPKLLIYVASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28017 - protein, 230 aa, Artificial Sequence; identical to SEQ ID NO: 27869
  Description of Artificial Sequence: Synthetic polypeptide
  XENP022861 [ICOS]_H0_L0.43_Fab_His Heavy Chain

SEQ ID NO: 28018 - protein, 214 aa, Artificial Sequence
  Description of Artificial Sequence: Synthetic polypeptide
  XENP022861 [ICOS]_H0_L0.43_Fab_His Light Chain
DIQMTQSPSSVSASVGDRVTITCQASQDISSYLAWYQQKPGKAPKLLIYAASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28019 - protein, 230 aa, Artificial Sequence; identical to SEQ ID NO: 27869
  Description of Artificial Sequence: Synthetic polypeptide
  XENP022862 [ICOS]_H0_L0.44_Fab_His Heavy Chain

SEQ ID NO: 28020 - protein, 214 aa, Artificial Sequence
  Description of Artificial Sequence: Synthetic polypeptide
  XENP022862 [ICOS]_H0_L0.44_Fab_His Light Chain
DIQMTQSPSSVSASVGDRVTITCQASQDISSYLAWYQQKPGKAPKLLIYAASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28021 - protein, 230 aa, Artificial Sequence
  Description of Artificial Sequence: Synthetic polypeptide
  XENP022863 [ICOS]_H0.35_L0.38_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28022 - protein, 214 aa, Artificial Sequence; identical to SEQ ID NO: 26557
  Description of Artificial Sequence: Synthetic polypeptide
  XENP022863 [ICOS]_H0.35_L0.38_Fab_His Light Chain

SEQ ID NO: 28023 - protein, 230 aa, Artificial Sequence; identical to SEQ ID NO: 28021
  Description of Artificial Sequence: Synthetic polypeptide
  XENP022864 [ICOS]_H0.35_L0.42_Fab_His Heavy Chain

SEQ ID NO: 28024 - protein, 214 aa, Artificial Sequence; identical to SEQ ID NO: 28016
  Description of Artificial Sequence: Synthetic polypeptide
  XENP022864 [ICOS]_H0.35_L0.42_Fab_His Light Chain

SEQ ID NO: 28025 - protein, 230 aa, Artificial Sequence; identical to SEQ ID NO: 28021
  Description of Artificial Sequence: Synthetic polypeptide
  XENP022865 [ICOS]_H0.35_L0.43_Fab_His Heavy Chain

SEQ ID NO: 28026 - protein, 214 aa, Artificial Sequence; identical to SEQ ID NO: 28018
  Description of Artificial Sequence: Synthetic polypeptide
  XENP022865 [ICOS]_H0.35_L0.43_Fab_His Light Chain

SEQ ID NO: 28027 - protein, 230 aa, Artificial Sequence; identical to SEQ ID NO: 28021
  Description of Artificial Sequence: Synthetic polypeptide
  XENP022866 [ICOS]_H0.35_L0.44_Fab_His Heavy Chain

SEQ ID NO: 28028 - protein, 214 aa, Artificial Sequence; identical to SEQ ID NO: 28020
  Description of Artificial Sequence: Synthetic polypeptide
  XENP022866 [ICOS]_H0.35_L0.44_Fab_His Light Chain

SEQ ID NO: 28029 - protein, 230 aa, Artificial Sequence
  Description of Artificial Sequence: Synthetic polypeptide
  XENP022867 [ICOS]_H0.61_L0.38_Fab_His Heavy Chain
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28030 - protein, 214 aa, Artificial Sequence; identical to SEQ ID NO: 26557
  Description of Artificial Sequence: Synthetic polypeptide
  XENP022867 [ICOS]_H0.61_L0.38_Fab_His Light Chain

SEQ ID NO: 28031 - protein, 230 aa, Artificial Sequence; identical to SEQ ID NO: 28029
  Description of Artificial Sequence: Synthetic polypeptide
  XENP022868 [ICOS]_H0.61_L0.42_Fab_His Heavy Chain

SEQ ID NO: 28032 - protein, 214 aa, Artificial Sequence; identical to SEQ ID NO: 28016
  Description of Artificial Sequence: Synthetic polypeptide
  XENP022868 [ICOS]_H0.61_L0.42_Fab_His Light Chain

SEQ ID NO: 28033 - protein, 230 aa, Artificial Sequence; identical to SEQ ID NO: 28029
  Description of Artificial Sequence: Synthetic polypeptide
  XENP022869 [ICOS]_H0.61_L0.43_Fab_His Heavy Chain

SEQ ID NO: 28034 - protein, 214 aa, Artificial Sequence; identical to SEQ ID NO: 28018
  Description of Artificial Sequence: Synthetic polypeptide
  XENP022869 [ICOS]_H0.61_L0.43_Fab_His Light Chain

SEQ ID NO: 28035 - protein, 230 aa, Artificial Sequence; identical to SEQ ID NO: 28029
  Description of Artificial Sequence: Synthetic polypeptide
  XENP022870 [ICOS]_H0.61_L0.44_Fab_His Heavy Chain

SEQ ID NO: 28036 - protein, 214 aa, Artificial Sequence; identical to SEQ ID NO: 28020
  Description of Artificial Sequence: Synthetic polypeptide
  XENP022870 [ICOS]_H0.61_L0.44_Fab_His Light Chain

SEQ ID NO: 28037 - protein, 230 aa, Artificial Sequence; identical to SEQ ID NO: 27917
  Description of Artificial Sequence: Synthetic polypeptide
  XENP022871 [ICOS]_H0.24_L0.38_Fab_His Heavy Chain

SEQ ID NO: 28038 - protein, 214 aa, Artificial Sequence; identical to SEQ ID NO: 26557
  Description of Artificial Sequence: Synthetic polypeptide
  XENP022871 [ICOS]_H0.24_L0.38_Fab_His Light Chain

SEQ ID NO: 28039 - protein, 230 aa, Artificial Sequence
  Description of Artificial Sequence: Synthetic polypeptide
  XENP022872 [ICOS]_H0.37_L0.38_Fab_His Heavy Chain
QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28040 - protein, 214 aa, Artificial Sequence; identical to SEQ ID NO: 26557
  Description of Artificial Sequence: Synthetic polypeptide
  XENP022872 [ICOS]_H0.37_L0.38_Fab_His Light Chain

SEQ ID NO: 28041 - protein, 230 aa, Artificial Sequence
  Description of Artificial Sequence: Synthetic polypeptide
  XENP022873 [ICOS]_H0.40_L0.38_Fab_His Heavy Chain
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28042 - protein, 214 aa, Artificial Sequence; identical to SEQ ID NO: 26557
  Description of Artificial Sequence: Synthetic polypeptide
  XENP022873 [ICOS]_H0.40_L0.38_Fab_His Light Chain

SEQ ID NO: 28043 - protein, 230 aa, Artificial Sequence
  Description of Artificial Sequence: Synthetic polypeptide
  XENP022874 [ICOS]_H0.44_L0.38_Fab_His Heavy Chain
QVQLVQSGAEVKKPGASVKVSCKASGYTFTGYYMHWVRQAPGQGLEWMGWINPHSGGTNYAQKFQGRVTITADESTSTAYMELSRLRSDDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28044 - protein, 214 aa, Artificial Sequence; identical to SEQ ID NO: 26557
  Description of Artificial Sequence: Synthetic polypeptide
  XENP022874 [ICOS]_H0.44_L0.38_Fab_His Light Chain

SEQ ID NO: 28045 - protein, 230 aa, Artificial Sequence
  Description of Artificial Sequence: Synthetic polypeptide
  XENP022875 [ICOS]_H0.56_L0.38_Fab_His Heavy Chain
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28046 - protein, 214 aa, Artificial Sequence; identical to SEQ ID NO: 26557
  Description of Artificial Sequence: Synthetic polypeptide
  XENP022875 [ICOS]_H0.56_L0.38_Fab_His Light Chain

SEQ ID NO: 28047 - protein, 230 aa, Artificial Sequence
  Description of Artificial Sequence: Synthetic polypeptide
  XENP022876 [ICOS]_H0.62_L0.38_Fab_His Heavy Chain
QVQLVQSGAEVKKPGASVKVSCKASGYTFTGYYMHWVRQAPGQGLEWMGWINPHSGGTNYAQKFQGRVTMTEDTSTDTAYMELSRLRSDDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28048 - protein, 214 aa, Artificial Sequence; identical to SEQ ID NO: 26557
  Description of Artificial Sequence: Synthetic polypeptide
  XENP022876 [ICOS]_H0.62_L0.38_Fab_His Light Chain

SEQ ID NO: 28049 - protein, 230 aa, Artificial Sequence; identical to SEQ ID NO: 28021
  Description of Artificial Sequence: Synthetic polypeptide
  XENP022929 [ICOS]_H0.35_L0.36_Fab_His Heavy Chain

SEQ ID NO: 28050 - protein, 214 aa, Artificial Sequence; identical to SEQ ID NO: 26517
  Description of Artificial Sequence: Synthetic polypeptide
  XENP022929 [ICOS]_H0.35_L0.36_Fab_His Light Chain

SEQ ID NO: 28051 - protein, 230 aa, Artificial Sequence; identical to SEQ ID NO: 28029
  Description of Artificial Sequence: Synthetic polypeptide
  XENP022930 [ICOS]_H0.61_L0.36_Fab_His Heavy Chain

SEQ ID NO: 28052 - protein, 214 aa, Artificial Sequence; identical to SEQ ID NO: 26517
  Description of Artificial Sequence: Synthetic polypeptide
  XENP022930 [ICOS]_H0.61_L0.36_Fab_His Light Chain

SEQ ID NO: 28053 - protein, 230 aa, Artificial Sequence; identical to SEQ ID NO: 27917
  Description of Artificial Sequence: Synthetic polypeptide
  XENP022938 [ICOS]_H0.24_L0.37_Fab_His Heavy Chain

SEQ ID NO: 28054 - protein, 214 aa, Artificial Sequence; identical to SEQ ID NO: 26537
  Description of Artificial Sequence: Synthetic polypeptide
  XENP022938 [ICOS]_H0.24_L0.37_Fab_His Light Chain

SEQ ID NO: 28055 - protein, 230 aa, Artificial Sequence; identical to SEQ ID NO: 28039
  Description of Artificial Sequence: Synthetic polypeptide
  XENP022939 [ICOS]_H0.37_L0.37_Fab_His Heavy Chain

SEQ ID NO: 28056 - protein, 214 aa, Artificial Sequence; identical to SEQ ID NO: 26537
  Description of Artificial Sequence: Synthetic polypeptide
  XENP022939 [ICOS]_H0.37_L0.37_Fab_His Light Chain

SEQ ID NO: 28057 - protein, 230 aa, Artificial Sequence; identical to SEQ ID NO: 28041
  Description of Artificial Sequence: Synthetic polypeptide
  XENP022940 [ICOS]_H0.40_L0.37_Fab_His Heavy Chain

SEQ ID NO: 28058 - protein, 214 aa, Artificial Sequence; identical to SEQ ID NO: 26537
  Description of Artificial Sequence: Synthetic polypeptide
  XENP022940 [ICOS]_H0.40_L0.37_Fab_His Light Chain

SEQ ID NO: 28059 - protein, 230 aa, Artificial Sequence; identical to SEQ ID NO: 28043
  Description of Artificial Sequence: Synthetic polypeptide
  XENP022941 [ICOS]_H0.44_L0.37_Fab_His Heavy Chain

SEQ ID NO: 28060 - protein, 214 aa, Artificial Sequence; identical to SEQ ID NO: 26537
  Description of Artificial Sequence: Synthetic polypeptide
  XENP022941 [ICOS]_H0.44_L0.37_Fab_His Light Chain

SEQ ID NO: 28061 - protein, 230 aa, Artificial Sequence; identical to SEQ ID NO: 28045
  Description of Artificial Sequence: Synthetic polypeptide
  XENP022942 [ICOS]_H0.56_L0.37_Fab_His Heavy Chain

SEQ ID NO: 28062 - protein, 214 aa, Artificial Sequence; identical to SEQ ID NO: 26537
  Description of Artificial Sequence: Synthetic polypeptide
  XENP022942 [ICOS]_H0.56_L0.37_Fab_His Light Chain

SEQ ID NO: 28063 - protein, 230 aa, Artificial Sequence; identical to SEQ ID NO: 28047
  Description of Artificial Sequence: Synthetic polypeptide
  XENP022943 [ICOS]_H0.62_L0.37_Fab_His Heavy Chain

SEQ ID NO: 28064 - protein, 214 aa, Artificial Sequence; identical to SEQ ID NO: 26537
  Description of Artificial Sequence: Synthetic polypeptide
  XENP022943 [ICOS]_H0.62_L0.37_Fab_His Light Chain

SEQ ID NO: 28065 - protein, 230 aa, Artificial Sequence; identical to SEQ ID NO: 28021
  Description of Artificial Sequence: Synthetic polypeptide
  XENP022944 [ICOS]_H0.35_L0.34_Fab_His Heavy Chain

SEQ ID NO: 28066 - protein, 214 aa, Artificial Sequence; identical to SEQ ID NO: 26497
  Description of Artificial Sequence: Synthetic polypeptide
  XENP022944 [ICOS]_H0.35_L0.34_Fab_His Light Chain

SEQ ID NO: 28067 - protein, 230 aa, Artificial Sequence; identical to SEQ ID NO: 28021
  Description of Artificial Sequence: Synthetic polypeptide
  XENP022945 [ICOS]_H0.35_L0.35_Fab_His Heavy Chain

SEQ ID NO: 28068 - protein, 214 aa, Artificial Sequence; identical to SEQ ID NO: 28008
  Description of Artificial Sequence: Synthetic polypeptide
  XENP022945 [ICOS]_H0.35_L0.35_Fab_His Light Chain

SEQ ID NO: 28069 - protein, 230 aa, Artificial Sequence; identical to SEQ ID NO: 28021
  Description of Artificial Sequence: Synthetic polypeptide
  XENP022946 [ICOS]_H0.35_L0.37_Fab_His Heavy Chain

SEQ ID NO: 28070 - protein, 214 aa, Artificial Sequence; identical to SEQ ID NO: 26537
  Description of Artificial Sequence: Synthetic polypeptide
  XENP022946 [ICOS]_H0.35_L0.37_Fab_His Light Chain

SEQ ID NO: 28071 - protein, 230 aa, Artificial Sequence; identical to SEQ ID NO: 28029
  Description of Artificial Sequence: Synthetic polypeptide
  XENP022947 [ICOS]_H0.61_L0.34_Fab_His Heavy Chain

SEQ ID NO: 28072 - protein, 214 aa, Artificial Sequence; identical to SEQ ID NO: 26497
  Description of Artificial Sequence: Synthetic polypeptide
  XENP022947 [ICOS]_H0.61_L0.34_Fab_His Light Chain

SEQ ID NO: 28073 - protein, 230 aa, Artificial Sequence; identical to SEQ ID NO: 28029
  Description of Artificial Sequence: Synthetic polypeptide
  XENP022948 [ICOS]_H0.61_L0.35_Fab_His Heavy Chain

SEQ ID NO: 28074 - protein, 214 aa, Artificial Sequence; identical to SEQ ID NO: 28008
  Description of Artificial Sequence: Synthetic polypeptide
  XENP022948 [ICOS]_H0.61_L0.35_Fab_His Light Chain

SEQ ID NO: 28075 - protein, 230 aa, Artificial Sequence; identical to SEQ ID NO: 28029
  Description of Artificial Sequence: Synthetic polypeptide
  XENP022949 [ICOS]_H0.61_L0.37_Fab_His Heavy Chain

SEQ ID NO: 28076 - protein, 214 aa, Artificial Sequence; identical to SEQ ID NO: 26537
  Description of Artificial Sequence: Synthetic polypeptide
  XENP022949 [ICOS]_H0.61_L0.37_Fab_His Light Chain

SEQ ID NO: 28077 - protein, 230 aa, Artificial Sequence; identical to SEQ ID NO: 28039
  Description of Artificial Sequence: Synthetic polypeptide
  XENP023086 [ICOS]_H0.37_L0_Fab_His Heavy Chain

SEQ ID NO: 28078 - protein, 214 aa, Artificial Sequence; identical to SEQ ID NO: 26297
  Description of Artificial Sequence: Synthetic polypeptide
  XENP023086 [ICOS]_H0.37_L0_Fab_His Light Chain

SEQ ID NO: 28079 - protein, 230 aa, Artificial Sequence
  Description of Artificial Sequence: Synthetic polypeptide
  XENP023087 [ICOS]_H0.64_L0_Fab_His Heavy Chain
QVQLVQSGAEVKKPGASVKVSCKASGYTFTGYYMHWVRQAPGQGLEWMGWINPHSGGTNYAQKFQGRVTMTEDTSTDTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28080 - protein, 214 aa, Artificial Sequence; identical to SEQ ID NO: 26297
  Description of Artificial Sequence: Synthetic polypeptide
  XENP023087 [ICOS]_H0.64_L0_Fab_His Light Chain

SEQ ID NO: 28081 - protein, 230 aa, Artificial Sequence
  Description of Artificial Sequence: Synthetic polypeptide
  XENP023088 [ICOS]_H0.66_L0_Fab_His Heavy Chain
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28082 - protein, 214 aa, Artificial Sequence; identical to SEQ ID NO: 26297
  Description of Artificial Sequence: Synthetic polypeptide
  XENP023088 [ICOS]_H0.66_L0_Fab_His Light Chain

SEQ ID NO: 28083 - protein, 230 aa, Artificial Sequence
  Description of Artificial Sequence: Synthetic polypeptide
  XENP023089 [ICOS]_H0.67_L0_Fab_His Heavy Chain
QVQLVQSGAEVKKPGASVKVSCKASGYTFTGYYMHWVRQAPGQGLEWMGWINPHSGETIYAQKFQGRVTMTEDTSTDTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 28084 - protein, 214 aa, Artificial Sequence; identical to SEQ ID NO: 26297
  Description of Artificial Sequence: Synthetic polypeptide
  XENP023089 [ICOS]_H0.67_L0_Fab_His Light Chain

SEQ ID NO: 28085 - protein, 230 aa, Artificial Sequence; identical to SEQ ID NO: 28081
  Description of Artificial Sequence: Synthetic polypeptide
  XENP023409 [ICOS]_H0.66_L0.34_Fab_His Heavy Chain

SEQ ID NO: 28086 - protein, 214 aa, Artificial Sequence; identical to SEQ ID NO: 26497
  Description of Artificial Sequence: Synthetic polypeptide
  XENP023409 [ICOS]_H0.66_L0.34_Fab_His Light Chain

SEQ ID NO: 28087 - protein, 454 aa, Artificial Sequence; identical to SEQ ID NO: 26442
  Description of Artificial Sequence: Synthetic polypeptide
  XENP020266 [ICOS]_H0L0 one-arm mAb Fab-Fc Heavy Chain

SEQ ID NO: 28088 - protein, 231 aa, Artificial Sequence; identical to SEQ ID NO: 27198
  Description of Artificial Sequence: Synthetic polypeptide
  XENP020266 [ICOS]_H0L0 one-arm mAb Fc-only Heavy Chain

SEQ ID NO: 28089 - protein, 214 aa, Artificial Sequence; identical to SEQ ID NO: 26297
  Description of Artificial Sequence: Synthetic polypeptide
  XENP020266 [ICOS]_H0L0 one-arm mAb Light Chain

SEQ ID NO: 28090 - protein, 454 aa, Artificial Sequence; identical to SEQ ID NO: 26442
  Description of Artificial Sequence: Synthetic polypeptide
  XENP022439 [ICOS]_H0_L0.5 one-arm mAb Fab-Fc Heavy Chain

SEQ ID NO: 28091 - protein, 231 aa, Artificial Sequence; identical to SEQ ID NO: 27198
  Description of Artificial Sequence: Synthetic polypeptide
  XENP022439 [ICOS]_H0_L0.5 one-arm mAb Fc-only Heavy Chain

SEQ ID NO: 28092 - protein, 214 aa, Artificial Sequence; identical to SEQ ID NO: 27243
  Description of Artificial Sequence: Synthetic polypeptide
  XENP022439 [ICOS]_H0_L0.5 one-arm mAb Light Chain

SEQ ID NO: 28093 - protein, 454 aa, Artificial Sequence; identical to SEQ ID NO: 26442
  Description of Artificial Sequence: Synthetic polypeptide
  XENP022440 [ICOS]_H0_L0.7 one-arm mAb Fab-Fc Heavy Chain

SEQ ID NO: 28094 - protein, 231 aa, Artificial Sequence; identical to SEQ ID NO: 27198
  Description of Artificial Sequence: Synthetic polypeptide
  XENP022440 [ICOS]_H0_L0.7 one-arm mAb Fc-only Heavy Chain

SEQ ID NO: 28095 - protein, 214 aa, Artificial Sequence; identical to SEQ ID NO: 26477
  Description of Artificial Sequence: Synthetic polypeptide
  XENP022440 [ICOS]_H0_L0.7 one-arm mAb Light Chain

SEQ ID NO: 28096 - protein, 454 aa, Artificial Sequence; identical to SEQ ID NO: 26442
  Description of Artificial Sequence: Synthetic polypeptide
  XENP022441 [ICOS]_H0_L0.9 one-arm mAb Fab-Fc Heavy Chain

SEQ ID NO: 28097 - protein, 231 aa, Artificial Sequence; identical to SEQ ID NO: 27198
  Description of Artificial Sequence: Synthetic polypeptide
  XENP022441 [ICOS]_H0_L0.9 one-arm mAb Fc-only Heavy Chain

SEQ ID NO: 28098 - protein, 214 aa, Artificial Sequence; identical to SEQ ID NO: 27265
  Description of Artificial Sequence: Synthetic polypeptide
  XENP022441 [ICOS]_H0_L0.9 one-arm mAb Light Chain

SEQ ID NO: 28099 - protein, 454 aa, Artificial Sequence; identical to SEQ ID NO: 26442
  Description of Artificial Sequence: Synthetic polypeptide
  XENP022442 [ICOS]_H0_L0.10 one-arm mAb Fab-Fc Heavy Chain

SEQ ID NO: 28100 - protein, 231 aa, Artificial Sequence; identical to SEQ ID NO: 27198
  Description of Artificial Sequence: Synthetic polypeptide
  XENP022442 [ICOS]_H0_L0.10 one-arm mAb Fc-only Heavy Chain

SEQ ID NO: 28101 - protein, 214 aa, Artificial Sequence; identical to SEQ ID NO: 27276
  Description of Artificial Sequence: Synthetic polypeptide
  XENP022442 [ICOS]_H0_L0.10 one-arm mAb Light Chain

SEQ ID NO: 28102 - protein, 454 aa, Artificial Sequence; identical to SEQ ID NO: 26442
  Description of Artificial Sequence: Synthetic polypeptide
  XENP022443 [ICOS]_H0_L0.14 one-arm mAb Fab-Fc Heavy Chain

SEQ ID NO: 28103 - protein, 231 aa, Artificial Sequence; identical to SEQ ID NO: 27198
  Description of Artificial Sequence: Synthetic polypeptide
  XENP022443 [ICOS]_H0_L0.14 one-arm mAb Fc-only Heavy Chain

SEQ ID NO: 28104 - protein, 214 aa, Artificial Sequence; identical to SEQ ID NO: 27287
  Description of Artificial Sequence: Synthetic polypeptide
  XENP022443 [ICOS]_H0_L0.14 one-arm mAb Light Chain

SEQ ID NO: 28105 - protein, 454 aa, Artificial Sequence; identical to SEQ ID NO: 26442
  Description of Artificial Sequence: Synthetic polypeptide
  XENP022444 [ICOS]_H0_L0.15 one-arm mAb Fab-Fc Heavy Chain

SEQ ID NO: 28106 - protein, 231 aa, Artificial Sequence; identical to SEQ ID NO: 27198
  Description of Artificial Sequence: Synthetic polypeptide
  XENP022444 [ICOS]_H0_L0.15 one-arm mAb Fc-only Heavy Chain

SEQ ID NO: 28107 - protein, 214 aa, Artificial Sequence; identical to SEQ ID NO: 27298
  Description of Artificial Sequence: Synthetic polypeptide
  XENP022444 [ICOS]_H0_L0.15 one-arm mAb Light Chain

SEQ ID NO: 28108 - protein, 454 aa, Artificial Sequence; identical to SEQ ID NO: 26442
  Description of Artificial Sequence: Synthetic polypeptide
  XENP022445 [ICOS]_H0_L0.20 one-arm mAb Fab-Fc Heavy Chain

SEQ ID NO: 28109 - protein, 231 aa, Artificial Sequence; identical to SEQ ID NO: 27198
  Description of Artificial Sequence: Synthetic polypeptide
  XENP022445 [ICOS]_H0_L0.20 one-arm mAb Fc-only Heavy Chain

SEQ ID NO: 28110 - protein, 214 aa, Artificial Sequence; identical to SEQ ID NO: 27309
  Description of Artificial Sequence: Synthetic polypeptide
  XENP022445 [ICOS]_H0_L0.20 one-arm mAb Light Chain

SEQ ID NO: 28111 - protein, 454 aa, Artificial Sequence; identical to SEQ ID NO: 26442
  Description of Artificial Sequence: Synthetic polypeptide
  XENP022749 [ICOS]_H0_L0.21 one-arm mAb Fab-Fc Heavy Chain

SEQ ID NO: 28112 - protein, 231 aa, Artificial Sequence; identical to SEQ ID NO: 27198
  Description of Artificial Sequence: Synthetic polypeptide
  XENP022749 [ICOS]_H0_L0.21 one-arm mAb Fc-only Heavy Chain

SEQ ID NO: 28113 - protein, 214 aa, Artificial Sequence; identical to SEQ ID NO: 27980
  Description of Artificial Sequence: Synthetic polypeptide
  XENP022749 [ICOS]_H0_L0.21 one-arm mAb Light Chain

SEQ ID NO: 28114 - protein, 454 aa, Artificial Sequence; identical to SEQ ID NO: 26442
  Description of Artificial Sequence: Synthetic polypeptide
  XENP022750 [ICOS]_H0_L0.22 one-arm mAb Fab-Fc Heavy Chain

SEQ ID NO: 28115 - protein, 231 aa, Artificial Sequence; identical to SEQ ID NO: 27198
  Description of Artificial Sequence: Synthetic polypeptide
  XENP022750 [ICOS]_H0_L0.22 one-arm mAb Fc-only Heavy Chain

SEQ ID NO: 28116 - protein, 214 aa, Artificial Sequence; identical to SEQ ID NO: 27982
  Description of Artificial Sequence: Synthetic polypeptide
  XENP022750 [ICOS]_H0_L0.22 one-arm mAb Light Chain

SEQ ID NO: 28117 - protein, 454 aa, Artificial Sequence; identical to SEQ ID NO: 26442
  Description of Artificial Sequence: Synthetic polypeptide
  XENP022751 [ICOS]_H0_L0.23 one-arm mAb Fab-Fc Heavy Chain

SEQ ID NO: 28118 - protein, 231 aa, Artificial Sequence; identical to SEQ ID NO: 27198
  Description of Artificial Sequence: Synthetic polypeptide
  XENP022751 [ICOS]_H0_L0.23 one-arm mAb Fc-only Heavy Chain

SEQ ID NO: 28119 - protein, 214 aa, Artificial Sequence; identical to SEQ ID NO: 27984
  Description of Artificial Sequence: Synthetic polypeptide
  XENP022751 [ICOS]_H0_L0.23 one-arm mAb Light Chain

SEQ ID NO: 28120 - protein, 454 aa, Artificial Sequence; identical to SEQ ID NO: 26442
  Description of Artificial Sequence: Synthetic polypeptide
  XENP022752 [ICOS]_H0_L0.24 one-arm mAb Fab-Fc Heavy Chain

SEQ ID NO: 28121 - protein, 231 aa, Artificial Sequence; identical to SEQ ID NO: 27198
  Description of Artificial Sequence: Synthetic polypeptide
  XENP022752 [ICOS]_H0_L0.24 one-arm mAb Fc-only Heavy Chain

SEQ ID NO: 28122 - protein, 214 aa, Artificial Sequence; identical to SEQ ID NO: 27986
  Description of Artificial Sequence: Synthetic polypeptide
  XENP022752 [ICOS]_H0_L0.24 one-arm mAb Light Chain

SEQ ID NO: 28123 - protein, 454 aa, Artificial Sequence; identical to SEQ ID NO: 26442
  Description of Artificial Sequence: Synthetic polypeptide
  XENP022753 [ICOS]_H0_L0.25 one-arm mAb Fab-Fc Heavy Chain

SEQ ID NO: 28124 - protein, 231 aa, Artificial Sequence; identical to SEQ ID NO: 27198
  Description of Artificial Sequence: Synthetic polypeptide
  XENP022753 [ICOS]_H0_L0.25 one-arm mAb Fc-only Heavy Chain

SEQ ID NO: 28125 - protein, 214 aa, Artificial Sequence; identical to SEQ ID NO: 27988
  Description of Artificial Sequence: Synthetic polypeptide
  XENP022753 [ICOS]_H0_L0.25 one-arm mAb Light Chain

SEQ ID NO: 28126 - protein, 454 aa, Artificial Sequence; identical to SEQ ID NO: 26442
  Description of Artificial Sequence: Synthetic polypeptide
  XENP022754 [ICOS]_H0_L0.26 one-arm mAb Fab-Fc Heavy Chain

SEQ ID NO: 28127 - protein, 231 aa, Artificial Sequence; identical to SEQ ID NO: 27198
  Description of Artificial Sequence: Synthetic polypeptide
  XENP022754 [ICOS]_H0_L0.26 one-arm mAb Fc-only Heavy Chain

SEQ ID NO: 28128 - protein, 214 aa, Artificial Sequence; identical to SEQ ID NO: 27990
  Description of Artificial Sequence: Synthetic polypeptide
  XENP022754 [ICOS]_H0_L0.26 one-arm mAb Light Chain

SEQ ID NO: 28129 - protein, 454 aa, Artificial Sequence; identical to SEQ ID NO: 26442
  Description of Artificial Sequence: Synthetic polypeptide
  XENP022755 [ICOS]_H0_L0.27 one-arm mAb Fab-Fc Heavy Chain

SEQ ID NO: 28130 - protein, 231 aa, Artificial Sequence; identical to SEQ ID NO: 27198
  Description of Artificial Sequence: Synthetic polypeptide
  XENP022755 [ICOS]_H0_L0.27 one-arm mAb Fc-only Heavy Chain

SEQ ID NO: 28131 - protein, 214 aa, Artificial Sequence; identical to SEQ ID NO: 27992
  Description of Artificial Sequence: Synthetic polypeptide
  XENP022755 [ICOS]_H0_L0.27 one-arm mAb Light Chain

SEQ ID NO: 28132 - protein, 454 aa, Artificial Sequence; identical to SEQ ID NO: 26442
  Description of Artificial Sequence: Synthetic polypeptide
  XENP022756 [ICOS]_H0_L0.28 one-arm mAb Fab-Fc Heavy Chain

SEQ ID NO: 28133 - protein, 231 aa, Artificial Sequence; identical to SEQ ID NO: 27198
  Description of Artificial Sequence: Synthetic polypeptide
  XENP022756 [ICOS]_H0_L0.28 one-arm mAb Fc-only Heavy Chain

SEQ ID NO: 28134 - protein, 214 aa, Artificial Sequence; identical to SEQ ID NO: 27994
  Description of Artificial Sequence: Synthetic polypeptide
  XENP022756 [ICOS]_H0_L0.28 one-arm mAb Light Chain

SEQ ID NO: 28135 - protein, 454 aa, Artificial Sequence; identical to SEQ ID NO: 26442
  Description of Artificial Sequence: Synthetic polypeptide
  XENP022757 [ICOS]_H0_L0.29 one-arm mAb Fab-Fc Heavy Chain

SEQ ID NO: 28136 - protein, 231 aa, Artificial Sequence; identical to SEQ ID NO: 27198
  Description of Artificial Sequence: Synthetic polypeptide
  XENP022757 [ICOS]_H0_L0.29 one-arm mAb Fc-only Heavy Chain

SEQ ID NO: 28137 - protein, 214 aa, Artificial Sequence; identical to SEQ ID NO: 27996
  Description of Artificial Sequence: Synthetic polypeptide
  XENP022757 [ICOS]_H0_L0.29 one-arm mAb Light Chain

SEQ ID NO: 28138 - protein, 454 aa, Artificial Sequence; identical to SEQ ID NO: 26442
  Description of Artificial Sequence: Synthetic polypeptide
  XENP022758 [ICOS]_H0_L0.30 one-arm mAb Fab-Fc Heavy Chain

SEQ ID NO: 28139 - protein, 231 aa, Artificial Sequence; identical to SEQ ID NO: 27198
  Description of Artificial Sequence: Synthetic polypeptide
  XENP022758 [ICOS]_H0_L0.30 one-arm mAb Fc-only Heavy Chain

SEQ ID NO: 28140 - protein, 214 aa, Artificial Sequence; identical to SEQ ID NO: 27998
  Description of Artificial Sequence: Synthetic polypeptide
  XENP022758 [ICOS]_H0_L0.30 one-arm mAb Light Chain

SEQ ID NO: 28141 - protein, 454 aa, Artificial Sequence; identical to SEQ ID NO: 26442
  Description of Artificial Sequence: Synthetic polypeptide
  XENP022759 [ICOS]_H0_L0.31 one-arm mAb Fab-Fc Heavy Chain

SEQ ID NO: 28142 - protein, 231 aa, Artificial Sequence; identical to SEQ ID NO: 27198
  Description of Artificial Sequence: Synthetic polypeptide
  XENP022759 [ICOS]_H0_L0.31 one-arm mAb Fc-only Heavy Chain

SEQ ID NO: 28143 - protein, 214 aa, Artificial Sequence; identical to SEQ ID NO: 28000
  Description of Artificial Sequence: Synthetic polypeptide
  XENP022759 [ICOS]_H0_L0.31 one-arm mAb Light Chain

SEQ ID NO: 28144 - protein, 454 aa, Artificial Sequence; identical to SEQ ID NO: 26442
  Description of Artificial Sequence: Synthetic polypeptide
  XENP022760 [ICOS]_H0_L0.32 one-arm mAb Fab-Fc Heavy Chain

SEQ ID NO: 28145 - protein, 231 aa, Artificial Sequence; identical to SEQ ID NO: 27198
  Description of Artificial Sequence: Synthetic polypeptide
  XENP022760 [ICOS]_H0_L0.32 one-arm mAb Fc-only Heavy Chain

SEQ ID NO: 28146 - protein, 214 aa, Artificial Sequence; identical to SEQ ID NO: 28002
  Description of Artificial Sequence: Synthetic polypeptide
  XENP022760 [ICOS]_H0_L0.32 one-arm mAb Light Chain

SEQ ID NO: 28147 - protein, 454 aa, Artificial Sequence; identical to SEQ ID NO: 26442
  Description of Artificial Sequence: Synthetic polypeptide
  XENP022761 [ICOS]_H0_L0.33 one-arm mAb Fab-Fc Heavy Chain

SEQ ID NO: 28148 - protein, 231 aa, Artificial Sequence; identical to SEQ ID NO: 27198
  Description of Artificial Sequence: Synthetic polypeptide
  XENP022761 [ICOS]_H0_L0.33 one-arm mAb Fc-only Heavy Chain

SEQ ID NO: 28149 - protein, 214 aa, Artificial Sequence; identical to SEQ ID NO: 28004
  Description of Artificial Sequence: Synthetic polypeptide
  XENP022761 [ICOS]_H0_L0.33 one-arm mAb Light Chain

SEQ ID NO: 28150 - protein, 454 aa, Artificial Sequence; identical to SEQ ID NO: 26442
  Description of Artificial Sequence: Synthetic polypeptide
  XENP022762 [ICOS]_H0_L0.34 one-arm mAb Fab-Fc Heavy Chain

SEQ ID NO: 28151 - protein, 231 aa, Artificial Sequence; identical to SEQ ID NO: 27198
  Description of Artificial Sequence: Synthetic polypeptide
  XENP022762 [ICOS]_H0_L0.34 one-arm mAb Fc-only Heavy Chain

SEQ ID NO: 28152 - protein, 214 aa, Artificial Sequence; identical to SEQ ID NO: 26497
  Description of Artificial Sequence: Synthetic polypeptide
  XENP022762 [ICOS]_H0_L0.34 one-arm mAb Light Chain

SEQ ID NO: 28153 - protein, 454 aa, Artificial Sequence; identical to SEQ ID NO: 26442
  Description of Artificial Sequence: Synthetic polypeptide
  XENP022763 [ICOS]_H0_L0.35 one-arm mAb Fab-Fc Heavy Chain

SEQ ID NO: 28154 - protein, 231 aa, Artificial Sequence; identical to SEQ ID NO: 27198
  Description of Artificial Sequence: Synthetic polypeptide
  XENP022763 [ICOS]_H0_L0.35 one-arm mAb Fc-only Heavy Chain

SEQ ID NO: 28155 - protein, 214 aa, Artificial Sequence; identical to SEQ ID NO: 28008
  Description of Artificial Sequence: Synthetic polypeptide
  XENP022763 [ICOS]_H0_L0.35 one-arm mAb Light Chain

SEQ ID NO: 28156 - protein, 454 aa, Artificial Sequence; identical to SEQ ID NO: 26442
  Description of Artificial Sequence: Synthetic polypeptide
  XENP022764 [ICOS]_H0_L0.36 one-arm mAb Fab-Fc Heavy Chain

SEQ ID NO: 28157 - protein, 231 aa, Artificial Sequence; identical to SEQ ID NO: 27198
  Description of Artificial Sequence: Synthetic polypeptide
  XENP022764 [ICOS]_H0_L0.36 one-arm mAb Fc-only Heavy Chain

SEQ ID NO: 28158 - protein, 214 aa, Artificial Sequence; identical to SEQ ID NO: 26517
  Description of Artificial Sequence: Synthetic polypeptide
  XENP022764 [ICOS]_H0_L0.36 one-arm mAb Light Chain

SEQ ID NO: 28159 - protein, 454 aa, Artificial Sequence; identical to SEQ ID NO: 26442
  Description of Artificial Sequence: Synthetic polypeptide
  XENP022765 [ICOS]_H0_L0.37 one-arm mAb Fab-Fc Heavy Chain

SEQ ID NO: 28160 - protein, 231 aa, Artificial Sequence; identical to SEQ ID NO: 27198
  Description of Artificial Sequence: Synthetic polypeptide
  XENP022765 [ICOS]_H0_L0.37 one-arm mAb Fc-only Heavy Chain

SEQ ID NO: 28161 - protein, 214 aa, Artificial Sequence; identical to SEQ ID NO: 26537
  Description of Artificial Sequence: Synthetic polypeptide
  XENP022765 [ICOS]_H0_L0.37 one-arm mAb Light Chain

SEQ ID NO: 28162 - protein, 454 aa, Artificial Sequence; identical to SEQ ID NO: 26442
  Description of Artificial Sequence: Synthetic polypeptide
  XENP022766 [ICOS]_H0_L0.38 one-arm mAb Fab-Fc Heavy Chain

SEQ ID NO: 28163 - protein, 231 aa, Artificial Sequence; identical to SEQ ID NO: 27198
  Description of Artificial Sequence: Synthetic polypeptide
  XENP022766 [ICOS]_H0_L0.38 one-arm mAb Fc-only Heavy Chain

SEQ ID NO: 28164 - protein, 214 aa, Artificial Sequence; identical to SEQ ID NO: 26557
  Description of Artificial Sequence: Synthetic polypeptide
  XENP022766 [ICOS]_H0_L0.38 one-arm mAb Light Chain

SEQ ID NO: 28165 - protein, 454 aa, Artificial Sequence; identical to SEQ ID NO: 26442
  Description of Artificial Sequence: Synthetic polypeptide
  XENP022896 [ICOS]_H0_L0.42 one-arm mAb Fab-Fc Heavy Chain

SEQ ID NO: 28166 - protein, 231 aa, Artificial Sequence; identical to SEQ ID NO: 27198
  Description of Artificial Sequence: Synthetic polypeptide
  XENP022896 [ICOS]_H0_L0.42 one-arm mAb Fc-only Heavy Chain

SEQ ID NO: 28167 - protein, 214 aa, Artificial Sequence; identical to SEQ ID NO: 28016
  Description of Artificial Sequence: Synthetic polypeptide
  XENP022896 [ICOS]_H0_L0.42 one-arm mAb Light Chain

SEQ ID NO: 28168 - protein, 454 aa, Artificial Sequence; identical to SEQ ID NO: 26442
  Description of Artificial Sequence: Synthetic polypeptide
  XENP022901 [ICOS]_H0_L0.43 one-arm mAb Fab-Fc Heavy Chain

SEQ ID NO: 28169 - protein, 231 aa, Artificial Sequence; identical to SEQ ID NO: 27198
  Description of Artificial Sequence: Synthetic polypeptide
  XENP022901 [ICOS]_H0_L0.43 one-arm mAb Fc-only Heavy Chain

SEQ ID NO: 28170 - protein, 214 aa, Artificial Sequence; identical to SEQ ID NO: 28018
  Description of Artificial Sequence: Synthetic polypeptide
  XENP022901 [ICOS]_H0_L0.43 one-arm mAb Light Chain

SEQ ID NO: 28171 - protein, 454 aa, Artificial Sequence; identical to SEQ ID NO: 26442
  Description of Artificial Sequence: Synthetic polypeptide
  XENP022902 [ICOS]_H0_L0.44 one-arm mAb Fab-Fc Heavy Chain

SEQ ID NO: 28172 - protein, 231 aa, Artificial Sequence; identical to SEQ ID NO: 27198
  Description of Artificial Sequence: Synthetic polypeptide
  XENP022902 [ICOS]_H0_L0.44 one-arm mAb Fc-only Heavy Chain

SEQ ID NO: 28173 - protein, 214 aa, Artificial Sequence; identical to SEQ ID NO: 28020
  Description of Artificial Sequence: Synthetic polypeptide
  XENP022902 [ICOS]_H0_L0.44 one-arm mAb Light Chain

SEQ ID NO: 28174 - protein, 454 aa, Artificial Sequence
  Description of Artificial Sequence: Synthetic polypeptide
  XENP022903 [ICOS]_H0.35_L0.38 one-arm mAb Fab-Fc Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28175 - protein, 231 aa, Artificial Sequence; identical to SEQ ID NO: 27198
  Description of Artificial Sequence: Synthetic polypeptide
  XENP022903 [ICOS]_H0.35_L0.38 one-arm mAb Fc-only Heavy Chain

SEQ ID NO: 28176 - protein, 214 aa, Artificial Sequence; identical to SEQ ID NO: 26557
  Description of Artificial Sequence: Synthetic polypeptide
  XENP022903 [ICOS]_H0.35_L0.38 one-arm mAb Light Chain

SEQ ID NO: 28177 - protein, 454 aa, Artificial Sequence; identical to SEQ ID NO: 28174
  Description of Artificial Sequence: Synthetic polypeptide
  XENP022904 [ICOS]_H0.35_L0.42 one-arm mAb Fab-Fc Heavy Chain

SEQ ID NO: 28178 - protein, 231 aa, Artificial Sequence; identical to SEQ ID NO: 27198
  Description of Artificial Sequence: Synthetic polypeptide
  XENP022904 [ICOS]_H0.35_L0.42 one-arm mAb Fc-only Heavy Chain

SEQ ID NO: 28179 - protein, 214 aa, Artificial Sequence; identical to SEQ ID NO: 28016
  Description of Artificial Sequence: Synthetic polypeptide
  XENP022904 [ICOS]_H0.35_L0.42 one-arm mAb Light Chain

SEQ ID NO: 28180 - protein, 454 aa, Artificial Sequence; identical to SEQ ID NO: 28174
  Description of Artificial Sequence: Synthetic polypeptide
  XENP022905 [ICOS]_H0.35_L0.43 one-arm mAb Fab-Fc Heavy Chain

SEQ ID NO: 28181 - protein, 231 aa, Artificial Sequence; identical to SEQ ID NO: 27198
  Description of Artificial Sequence: Synthetic polypeptide
  XENP022905 [ICOS]_H0.35_L0.43 one-arm mAb Fc-only Heavy Chain

SEQ ID NO: 28182 - protein, 214 aa, Artificial Sequence; identical to SEQ ID NO: 28018
  Description of Artificial Sequence: Synthetic polypeptide
  XENP022905 [ICOS]_H0.35_L0.43 one-arm mAb Light Chain

SEQ ID NO: 28183 - protein, 454 aa, Artificial Sequence; identical to SEQ ID NO: 28174
  Description of Artificial Sequence: Synthetic polypeptide
  XENP022906 [ICOS]_H0.35_L0.44 one-arm mAb Fab-Fc Heavy Chain

SEQ ID NO: 28184 - protein, 231 aa, Artificial Sequence; identical to SEQ ID NO: 27198
  Description of Artificial Sequence: Synthetic polypeptide
  XENP022906 [ICOS]_H0.35_L0.44 one-arm mAb Fc-only Heavy Chain

SEQ ID NO: 28185 - protein, 214 aa, Artificial Sequence; identical to SEQ ID NO: 28020
  Description of Artificial Sequence: Synthetic polypeptide
  XENP022906 [ICOS]_H0.35_L0.44 one-arm mAb Light Chain

SEQ ID NO: 28186 - protein, 454 aa, Artificial Sequence
  Description of Artificial Sequence: Synthetic polypeptide
  XENP022907 [ICOS]_H0.61_L0.38 one-arm mAb Fab-Fc Heavy Chain
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28187 - protein, 231 aa, Artificial Sequence; identical to SEQ ID NO: 27198
  Description of Artificial Sequence: Synthetic polypeptide
  XENP022907 [ICOS]_H0.61_L0.38 one-arm mAb Fc-only Heavy Chain

SEQ ID NO: 28188 - protein, 214 aa, Artificial Sequence; identical to SEQ ID NO: 26557
  Description of Artificial Sequence: Synthetic polypeptide
  XENP022907 [ICOS]_H0.61_L0.38 one-arm mAb Light Chain

SEQ ID NO: 28189 - protein, 454 aa, Artificial Sequence; identical to SEQ ID NO: 28186
  Description of Artificial Sequence: Synthetic polypeptide
  XENP022908 [ICOS]_H0.61_L0.42 one-arm mAb Fab-Fc Heavy Chain

SEQ ID NO: 28190 - protein, 231 aa, Artificial Sequence; identical to SEQ ID NO: 27198
  Description of Artificial Sequence: Synthetic polypeptide
  XENP022908 [ICOS]_H0.61_L0.42 one-arm mAb Fc-only Heavy Chain

SEQ ID NO: 28191 - protein, 214 aa, Artificial Sequence; identical to SEQ ID NO: 28016
  Description of Artificial Sequence: Synthetic polypeptide
  XENP022908 [ICOS]_H0.61_L0.42 one-arm mAb Light Chain

SEQ ID NO: 28192 - protein, 454 aa, Artificial Sequence; identical to SEQ ID NO: 28186
  Description of Artificial Sequence: Synthetic polypeptide
  XENP022909 [ICOS]_H0.61_L0.43 one-arm mAb Fab-Fc Heavy Chain

SEQ ID NO: 28193 - protein, 231 aa, Artificial Sequence; identical to SEQ ID NO: 27198
  Description of Artificial Sequence: Synthetic polypeptide
  XENP022909 [ICOS]_H0.61_L0.43 one-arm mAb Fc-only Heavy Chain

SEQ ID NO: 28194 - protein, 214 aa, Artificial Sequence; identical to SEQ ID NO: 28018
  Description of Artificial Sequence: Synthetic polypeptide
  XENP022909 [ICOS]_H0.61_L0.43 one-arm mAb Light Chain

SEQ ID NO: 28195 - protein, 454 aa, Artificial Sequence; identical to SEQ ID NO: 28186
  Description of Artificial Sequence: Synthetic polypeptide
  XENP022910 [ICOS]_H0.61_L0.44 one-arm mAb Fab-Fc Heavy Chain

SEQ ID NO: 28196 - protein, 231 aa, Artificial Sequence; identical to SEQ ID NO: 27198
  Description of Artificial Sequence: Synthetic polypeptide
  XENP022910 [ICOS]_H0.61_L0.44 one-arm mAb Fc-only Heavy Chain

SEQ ID NO: 28197 - protein, 214 aa, Artificial Sequence; identical to SEQ ID NO: 28020
  Description of Artificial Sequence: Synthetic polypeptide
  XENP022910 [ICOS]_H0.61_L0.44 one-arm mAb Light Chain

SEQ ID NO: 28198 - protein, 454 aa, Artificial Sequence
  Description of Artificial Sequence: Synthetic polypeptide
  XENP022911 [ICOS]_H0.24_L0.38 one-arm mAb Fab-Fc Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28199 - protein, 231 aa, Artificial Sequence; identical to SEQ ID NO: 27198
  Description of Artificial Sequence: Synthetic polypeptide
  XENP022911 [ICOS]_H0.24_L0.38 one-arm mAb Fc-only Heavy Chain

SEQ ID NO: 28200 - protein, 214 aa, Artificial Sequence; identical to SEQ ID NO: 26557
  Description of Artificial Sequence: Synthetic polypeptide
  XENP022911 [ICOS]_H0.24_L0.38 one-arm mAb Light Chain

SEQ ID NO: 28201 - protein, 454 aa, Artificial Sequence
  Description of Artificial Sequence: Synthetic polypeptide
  XENP022912 [ICOS]_H0.37_L0.38 one-arm mAb Fab-Fc Heavy Chain
QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28202 - protein, 231 aa, Artificial Sequence; identical to SEQ ID NO: 27198
  Description of Artificial Sequence: Synthetic polypeptide
  XENP022912 [ICOS]_H0.37_L0.38 one-arm mAb Fc-only Heavy Chain

SEQ ID NO: 28203 - protein, 214 aa, Artificial Sequence; identical to SEQ ID NO: 26557
  Description of Artificial Sequence: Synthetic polypeptide
  XENP022912 [ICOS]_H0.37_L0.38 one-arm mAb Light Chain

SEQ ID NO: 28204 - protein, 454 aa, Artificial Sequence
  Description of Artificial Sequence: Synthetic polypeptide
  XENP022913 [ICOS]_H0.40_L0.38 one-arm mAb Fab-Fc Heavy Chain
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28205 - protein, 231 aa, Artificial Sequence; identical to SEQ ID NO: 27198
  Description of Artificial Sequence: Synthetic polypeptide
  XENP022913 [ICOS]_H0.40_L0.38 one-arm mAb Fc-only Heavy Chain

SEQ ID NO: 28206 - protein, 214 aa, Artificial Sequence; identical to SEQ ID NO: 26557
  Description of Artificial Sequence: Synthetic polypeptide
  XENP022913 [ICOS]_H0.40_L0.38 one-arm mAb Light Chain

SEQ ID NO: 28207 - protein, 454 aa, Artificial Sequence
  Description of Artificial Sequence: Synthetic polypeptide
  XENP022914 [ICOS]_H0.44_L0.38 one-arm mAb Fab-Fc Heavy Chain
QVQLVQSGAEVKKPGASVKVSCKASGYTFTGYYMHWVRQAPGQGLEWMGWINPHSGGTNYAQKFQGRVTITADESTSTAYMELSRLRSDDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28208 - protein, 231 aa, Artificial Sequence; identical to SEQ ID NO: 27198
  Description of Artificial Sequence: Synthetic polypeptide
  XENP022914 [ICOS]_H0.44_L0.38 one-arm mAb Fc-only Heavy Chain

SEQ ID NO: 28209 - protein, 214 aa, Artificial Sequence; identical to SEQ ID NO: 26557
  Description of Artificial Sequence: Synthetic polypeptide
  XENP022914 [ICOS]_H0.44_L0.38 one-arm mAb Light Chain

SEQ ID NO: 28210 - protein, 454 aa, Artificial Sequence
  Description of Artificial Sequence: Synthetic polypeptide
  XENP022915 [ICOS]_H0.56_L0.38 one-arm mAb Fab-Fc Heavy Chain
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28211 - protein, 231 aa, Artificial Sequence; identical to SEQ ID NO: 27198
  Description of Artificial Sequence: Synthetic polypeptide
  XENP022915 [ICOS]_H0.56_L0.38 one-arm mAb Fc-only Heavy Chain

SEQ ID NO: 28212 - protein, 214 aa, Artificial Sequence; identical to SEQ ID NO: 26557
  Description of Artificial Sequence: Synthetic polypeptide
  XENP022915 [ICOS]_H0.56_L0.38 one-arm mAb Light Chain

SEQ ID NO: 28213 - protein, 454 aa, Artificial Sequence
  Description of Artificial Sequence: Synthetic polypeptide
  XENP022916 [ICOS]_H0.62_L0.38 one-arm mAb Fab-Fc Heavy Chain
QVQLVQSGAEVKKPGASVKVSCKASGYTFTGYYMHWVRQAPGQGLEWMGWINPHSGGTNYAQKFQGRVTMTEDTSTDTAYMELSRLRSDDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28214 - protein, 231 aa, Artificial Sequence; identical to SEQ ID NO: 27198
  Description of Artificial Sequence: Synthetic polypeptide
  XENP022916 [ICOS]_H0.62_L0.38 one-arm mAb Fc-only Heavy Chain

SEQ ID NO: 28215 - protein, 214 aa, Artificial Sequence; identical to SEQ ID NO: 26557
  Description of Artificial Sequence: Synthetic polypeptide
  XENP022916 [ICOS]_H0.62_L0.38 one-arm mAb Light Chain

SEQ ID NO: 28216 - protein, 454 aa, Artificial Sequence; identical to SEQ ID NO: 28174
  Description of Artificial Sequence: Synthetic polypeptide
  XENP022933 [ICOS]_H0.35_L0.36 one-arm mAb Fab-Fc Heavy Chain

SEQ ID NO: 28217 - protein, 231 aa, Artificial Sequence; identical to SEQ ID NO: 27198
  Description of Artificial Sequence: Synthetic polypeptide
  XENP022933 [ICOS]_H0.35_L0.36 one-arm mAb Fc-only Heavy Chain

SEQ ID NO: 28218 - protein, 214 aa, Artificial Sequence; identical to SEQ ID NO: 26517
  Description of Artificial Sequence: Synthetic polypeptide
  XENP022933 [ICOS]_H0.35_L0.36 one-arm mAb Light Chain

SEQ ID NO: 28219 - protein, 454 aa, Artificial Sequence; identical to SEQ ID NO: 28186
  Description of Artificial Sequence: Synthetic polypeptide
  XENP022934 [ICOS]_H0.61_L0.36 one-arm mAb Fab-Fc Heavy Chain

SEQ ID NO: 28220 - protein, 231 aa, Artificial Sequence; identical to SEQ ID NO: 27198
  Description of Artificial Sequence: Synthetic polypeptide
  XENP022934 [ICOS]_H0.61_L0.36 one-arm mAb Fc-only Heavy Chain

SEQ ID NO: 28221 - protein, 214 aa, Artificial Sequence; identical to SEQ ID NO: 26517
  Description of Artificial Sequence: Synthetic polypeptide
  XENP022934 [ICOS]_H0.61_L0.36 one-arm mAb Light Chain

SEQ ID NO: 28222 - protein, 454 aa, Artificial Sequence; identical to SEQ ID NO: 28198
  Description of Artificial Sequence: Synthetic polypeptide
  XENP022962 [ICOS]_H0.24_L0.37 one-arm mAb Fab-Fc Heavy Chain

SEQ ID NO: 28223 - protein, 231 aa, Artificial Sequence; identical to SEQ ID NO: 27198
  Description of Artificial Sequence: Synthetic polypeptide
  XENP022962 [ICOS]_H0.24_L0.37 one-arm mAb Fc-only Heavy Chain

SEQ ID NO: 28224 - protein, 214 aa, Artificial Sequence; identical to SEQ ID NO: 26537
  Description of Artificial Sequence: Synthetic polypeptide
  XENP022962 [ICOS]_H0.24_L0.37 one-arm mAb Light Chain

SEQ ID NO: 28225 - protein, 454 aa, Artificial Sequence; identical to SEQ ID NO: 28201
  Description of Artificial Sequence: Synthetic polypeptide
  XENP022963 [ICOS]_H0.37_L0.37 one-arm mAb Fab-Fc Heavy Chain

SEQ ID NO: 28226 - protein, 231 aa, Artificial Sequence; identical to SEQ ID NO: 27198
  Description of Artificial Sequence: Synthetic polypeptide
  XENP022963 [ICOS]_H0.37_L0.37 one-arm mAb Fc-only Heavy Chain

SEQ ID NO: 28227 - protein, 214 aa, Artificial Sequence; identical to SEQ ID NO: 26537
  Description of Artificial Sequence: Synthetic polypeptide
  XENP022963 [ICOS]_H0.37_L0.37 one-arm mAb Light Chain

SEQ ID NO: 28228 - protein, 454 aa, Artificial Sequence; identical to SEQ ID NO: 28204
  Description of Artificial Sequence: Synthetic polypeptide
  XENP022964 [ICOS]_H0.40_L0.37 one-arm mAb Fab-Fc Heavy Chain

SEQ ID NO: 28229 - protein, 231 aa, Artificial Sequence; identical to SEQ ID NO: 27198
  Description of Artificial Sequence: Synthetic polypeptide
  XENP022964 [ICOS]_H0.40_L0.37 one-arm mAb Fc-only Heavy Chain

SEQ ID NO: 28230 - protein, 214 aa, Artificial Sequence; identical to SEQ ID NO: 26537
  Description of Artificial Sequence: Synthetic polypeptide
  XENP022964 [ICOS]_H0.40_L0.37 one-arm mAb Light Chain

SEQ ID NO: 28231 - protein, 454 aa, Artificial Sequence; identical to SEQ ID NO: 28207
  Description of Artificial Sequence: Synthetic polypeptide
  XENP022965 [ICOS]_H0.44_L0.37 one-arm mAb Fab-Fc Heavy Chain

SEQ ID NO: 28232 - protein, 231 aa, Artificial Sequence; identical to SEQ ID NO: 27198
  Description of Artificial Sequence: Synthetic polypeptide
  XENP022965 [ICOS]_H0.44_L0.37 one-arm mAb Fc-only Heavy Chain

SEQ ID NO: 28233 - protein, 214 aa, Artificial Sequence; identical to SEQ ID NO: 26537
  Description of Artificial Sequence: Synthetic polypeptide
  XENP022965 [ICOS]_H0.44_L0.37 one-arm mAb Light Chain

SEQ ID NO: 28234 - protein, 454 aa, Artificial Sequence; identical to SEQ ID NO: 28210
  Description of Artificial Sequence: Synthetic polypeptide
  XENP022966 [ICOS]_H0.56_L0.37 one-arm mAb Fab-Fc Heavy Chain

SEQ ID NO: 28235 - protein, 231 aa, Artificial Sequence; identical to SEQ ID NO: 27198
  Description of Artificial Sequence: Synthetic polypeptide
  XENP022966 [ICOS]_H0.56_L0.37 one-arm mAb Fc-only Heavy Chain

SEQ ID NO: 28236 - protein, 214 aa, Artificial Sequence; identical to SEQ ID NO: 26537
  Description of Artificial Sequence: Synthetic polypeptide
  XENP022966 [ICOS]_H0.56_L0.37 one-arm mAb Light Chain

SEQ ID NO: 28237 - protein, 454 aa, Artificial Sequence; identical to SEQ ID NO: 28213
  Description of Artificial Sequence: Synthetic polypeptide
  XENP022967 [ICOS]_H0.62_L0.37 one-arm mAb Fab-Fc Heavy Chain

SEQ ID NO: 28238 - protein, 231 aa, Artificial Sequence; identical to SEQ ID NO: 27198
  Description of Artificial Sequence: Synthetic polypeptide
  XENP022967 [ICOS]_H0.62_L0.37 one-arm mAb Fc-only Heavy Chain

SEQ ID NO: 28239 - protein, 214 aa, Artificial Sequence; identical to SEQ ID NO: 26537
  Description of Artificial Sequence: Synthetic polypeptide
  XENP022967 [ICOS]_H0.62_L0.37 one-arm mAb Light Chain

SEQ ID NO: 28240 - protein, 454 aa, Artificial Sequence; identical to SEQ ID NO: 28174
  Description of Artificial Sequence: Synthetic polypeptide
  XENP022968 [ICOS]_H0.35_L0.34 one-arm mAb Fab-Fc Heavy Chain

SEQ ID NO: 28241 - protein, 231 aa, Artificial Sequence; identical to SEQ ID NO: 27198
  Description of Artificial Sequence: Synthetic polypeptide
  XENP022968 [ICOS]_H0.35_L0.34 one-arm mAb Fc-only Heavy Chain

SEQ ID NO: 28242 - protein, 214 aa, Artificial Sequence; identical to SEQ ID NO: 26497
  Description of Artificial Sequence: Synthetic polypeptide
  XENP022968 [ICOS]_H0.35_L0.34 one-arm mAb Light Chain

SEQ ID NO: 28243 - protein, 454 aa, Artificial Sequence; identical to SEQ ID NO: 28174
  Description of Artificial Sequence: Synthetic polypeptide
  XENP022969 [ICOS]_H0.35_L0.35 one-arm mAb Fab-Fc Heavy Chain

SEQ ID NO: 28244 - protein, 231 aa, Artificial Sequence; identical to SEQ ID NO: 27198
  Description of Artificial Sequence: Synthetic polypeptide
  XENP022969 [ICOS]_H0.35_L0.35 one-arm mAb Fc-only Heavy Chain

SEQ ID NO: 28245 - protein, 214 aa, Artificial Sequence; identical to SEQ ID NO: 28008
  Description of Artificial Sequence: Synthetic polypeptide
  XENP022969 [ICOS]_H0.35_L0.35 one-arm mAb Light Chain

SEQ ID NO: 28246 - protein, 454 aa, Artificial Sequence; identical to SEQ ID NO: 28174
  Description of Artificial Sequence: Synthetic polypeptide
  XENP022970 [ICOS]_H0.35_L0.37 one-arm mAb Fab-Fc Heavy Chain

SEQ ID NO: 28247 - protein, 231 aa, Artificial Sequence; identical to SEQ ID NO: 27198
  Description of Artificial Sequence: Synthetic polypeptide
  XENP022970 [ICOS]_H0.35_L0.37 one-arm mAb Fc-only Heavy Chain

SEQ ID NO: 28248 - protein, 214 aa, Artificial Sequence; identical to SEQ ID NO: 26537
  Description of Artificial Sequence: Synthetic polypeptide
  XENP022970 [ICOS]_H0.35_L0.37 one-arm mAb Light Chain

SEQ ID NO: 28249 - protein, 454 aa, Artificial Sequence; identical to SEQ ID NO: 28186
  Description of Artificial Sequence: Synthetic polypeptide
  XENP022971 [ICOS]_H0.61_L0.34 one-arm mAb Fab-Fc Heavy Chain

SEQ ID NO: 28250 - protein, 231 aa, Artificial Sequence; identical to SEQ ID NO: 27198
  Description of Artificial Sequence: Synthetic polypeptide
  XENP022971 [ICOS]_H0.61_L0.34 one-arm mAb Fc-only Heavy Chain

SEQ ID NO: 28251 - protein, 214 aa, Artificial Sequence; identical to SEQ ID NO: 26497
  Description of Artificial Sequence: Synthetic polypeptide
  XENP022971 [ICOS]_H0.61_L0.34 one-arm mAb Light Chain

SEQ ID NO: 28252 - protein, 454 aa, Artificial Sequence; identical to SEQ ID NO: 28186
  Description of Artificial Sequence: Synthetic polypeptide
  XENP022972 [ICOS]_H0.61_L0.35 one-arm mAb Fab-Fc Heavy Chain

SEQ ID NO: 28253 - protein, 231 aa, Artificial Sequence; identical to SEQ ID NO: 27198
  Description of Artificial Sequence: Synthetic polypeptide
  XENP022972 [ICOS]_H0.61_L0.35 one-arm mAb Fc-only Heavy Chain

SEQ ID NO: 28254 - protein, 214 aa, Artificial Sequence; identical to SEQ ID NO: 28008
  Description of Artificial Sequence: Synthetic polypeptide
  XENP022972 [ICOS]_H0.61_L0.35 one-arm mAb Light Chain

SEQ ID NO: 28255 - protein, 454 aa, Artificial Sequence; identical to SEQ ID NO: 28186
  Description of Artificial Sequence: Synthetic polypeptide
  XENP022973 [ICOS]_H0.61_L0.37 one-arm mAb Fab-Fc Heavy Chain

SEQ ID NO: 28256 - protein, 231 aa, Artificial Sequence; identical to SEQ ID NO: 27198
  Description of Artificial Sequence: Synthetic polypeptide
  XENP022973 [ICOS]_H0.61_L0.37 one-arm mAb Fc-only Heavy Chain

SEQ ID NO: 28257 - protein, 214 aa, Artificial Sequence; identical to SEQ ID NO: 26537
  Description of Artificial Sequence: Synthetic polypeptide
  XENP022973 [ICOS]_H0.61_L0.37 one-arm mAb Light Chain

SEQ ID NO: 28258 - protein, 454 aa, Artificial Sequence; identical to SEQ ID NO: 28201
  Description of Artificial Sequence: Synthetic polypeptide
  XENP023094 [ICOS]_H0.37_L0 one-arm mAb Fab-Fc Heavy Chain

SEQ ID NO: 28259 - protein, 231 aa, Artificial Sequence; identical to SEQ ID NO: 27198
  Description of Artificial Sequence: Synthetic polypeptide
  XENP023094 [ICOS]_H0.37_L0 one-arm mAb Fc-only Heavy Chain

SEQ ID NO: 28260 - protein, 214 aa, Artificial Sequence; identical to SEQ ID NO: 26297
  Description of Artificial Sequence: Synthetic polypeptide
  XENP023094 [ICOS]_H0.37_L0 one-arm mAb Light Chain

SEQ ID NO: 28261 - protein, 454 aa, Artificial Sequence
  Description of Artificial Sequence: Synthetic polypeptide
  XENP023095 [ICOS]_H0.64_L0 one-arm mAb Fab-Fc Heavy Chain
QVQLVQSGAEVKKPGASVKVSCKASGYTFTGYYMHWVRQAPGQGLEWMGWINPHSGGTNYAQKFQGRVTMTEDTSTDTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28262 - protein, 231 aa, Artificial Sequence; identical to SEQ ID NO: 27198
  Description of Artificial Sequence: Synthetic polypeptide
  XENP023095 [ICOS]_H0.64_L0 one-arm mAb Fc-only Heavy Chain

SEQ ID NO: 28263 - protein, 214 aa, Artificial Sequence; identical to SEQ ID NO: 26297
  Description of Artificial Sequence: Synthetic polypeptide
  XENP023095 [ICOS]_H0.64_L0 one-arm mAb Light Chain

SEQ ID NO: 28264 - protein, 454 aa, Artificial Sequence; identical to SEQ ID NO: 26562
  Description of Artificial Sequence: Synthetic polypeptide
  XENP023096 [ICOS]_H0.66_L0 one-arm mAb Fab-Fc Heavy Chain

SEQ ID NO: 28265 - protein, 231 aa, Artificial Sequence; identical to SEQ ID NO: 27198
  Description of Artificial Sequence: Synthetic polypeptide
  XENP023096 [ICOS]_H0.66_L0 one-arm mAb Fc-only Heavy Chain

SEQ ID NO: 28266 - protein, 214 aa, Artificial Sequence; identical to SEQ ID NO: 26297
  Description of Artificial Sequence: Synthetic polypeptide
  XENP023096 [ICOS]_H0.66_L0 one-arm mAb Light Chain

SEQ ID NO: 28267 - protein, 454 aa, Artificial Sequence
  Description of Artificial Sequence: Synthetic polypeptide
  XENP023101 [ICOS]_H0.67_L0 one-arm mAb Fab-Fc Heavy Chain
QVQLVQSGAEVKKPGASVKVSCKASGYTFTGYYMHWVRQAPGQGLEWMGWINPHSGETIYAQKFQGRVTMTEDTSTDTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28268 - protein, 231 aa, Artificial Sequence; identical to SEQ ID NO: 27198
  Description of Artificial Sequence: Synthetic polypeptide
  XENP023101 [ICOS]_H0.67_L0 one-arm mAb Fc-only Heavy Chain

SEQ ID NO: 28269 - protein, 214 aa, Artificial Sequence; identical to SEQ ID NO: 26297
  Description of Artificial Sequence: Synthetic polypeptide
  XENP023101 [ICOS]_H0.67_L0 one-arm mAb Light Chain

SEQ ID NO: 28270 - protein, 454 aa, Artificial Sequence; identical to SEQ ID NO: 26442
  Description of Artificial Sequence: Synthetic polypeptide
  XENP020896 [ICOS]_H0L0 _Fab-1G6_L1.194_H1.279 Fab-Fc Heavy Chain

SEQ ID NO: 28271 - protein, 480 aa, Artificial Sequence; identical to SEQ ID NO: 2870
  Description of Artificial Sequence: Synthetic polypeptide
  XENP020896 [ICOS]_H0L0 _Fab-1G6_L1.194_H1.279 scFv-Fc Heavy Chain

SEQ ID NO: 28272 - protein, 214 aa, Artificial Sequence; identical to SEQ ID NO: 26297
  Description of Artificial Sequence: Synthetic polypeptide
  XENP020896 [ICOS]_H0L0_Fab-1G6_L1.194_H1.279 Light Chain

SEQ ID NO: 28273 - protein, 454 aa, Artificial Sequence; identical to SEQ ID NO: 26442
  Description of Artificial Sequence: Synthetic polypeptide
  XENP022432 [ICOS]_H0_L0.5_Fab-1G6_L1.194_H1.279 Fab-Fc Heavy Chain

SEQ ID NO: 28274 - protein, 480 aa, Artificial Sequence; identical to SEQ ID NO: 2870
  Description of Artificial Sequence: Synthetic polypeptide
  XENP022432 [ICOS]_H0_L0.5_Fab-1G6_L1.194_H1.279 scFv-Fc Heavy Chain

SEQ ID NO: 28275 - protein, 214 aa, Artificial Sequence; identical to SEQ ID NO: 27243
  Description of Artificial Sequence: Synthetic polypeptide
  XENP022432 [ICOS]_H0_L0.5_Fab-1G6_L1.194_H1.279 Light Chain

SEQ ID NO: 28276 - protein, 454 aa, Artificial Sequence; identical to SEQ ID NO: 26442
  Description of Artificial Sequence: Synthetic polypeptide
  XENP022433 [ICOS]_H0_L0.7_Fab-1G6_L1.194_H1.279 Fab-Fc Heavy Chain

SEQ ID NO: 28277 - protein, 480 aa, Artificial Sequence; identical to SEQ ID NO: 2870
  Description of Artificial Sequence: Synthetic polypeptide
  XENP022433 [ICOS]_H0_L0.7_Fab-1G6_L1.194_H1.279 scFv-Fc Heavy Chain

SEQ ID NO: 28278 - protein, 214 aa, Artificial Sequence; identical to SEQ ID NO: 26477
  Description of Artificial Sequence: Synthetic polypeptide
  XENP022433 [ICOS]_H0_L0.7_Fab-1G6_L1.194_H1.279 Light Chain

SEQ ID NO: 28279 - protein, 454 aa, Artificial Sequence; identical to SEQ ID NO: 26442
  Description of Artificial Sequence: Synthetic polypeptide
  XENP022434 [ICOS]_H0_L0.9_Fab-1G6_L1.194_H1.279 Fab-Fc Heavy Chain

SEQ ID NO: 28280 - protein, 480 aa, Artificial Sequence; identical to SEQ ID NO: 2870
  Description of Artificial Sequence: Synthetic polypeptide
  XENP022434 [ICOS]_H0_L0.9_Fab-1G6_L1.194_H1.279 scFv-Fc Heavy Chain

SEQ ID NO: 28281 - protein, 214 aa, Artificial Sequence; identical to SEQ ID NO: 27265
  Description of Artificial Sequence: Synthetic polypeptide
  XENP022434 [ICOS]_H0_L0.9_Fab-1G6_L1.194_H1.279 Light Chain

SEQ ID NO: 28282 - protein, 454 aa, Artificial Sequence; identical to SEQ ID NO: 26442
  Description of Artificial Sequence: Synthetic polypeptide
  XENP022435 [ICOS]_H0_L0.10_Fab-1G6_L1.194_H1.279 Fab-Fc Heavy Chain

SEQ ID NO: 28283 - protein, 480 aa, Artificial Sequence; identical to SEQ ID NO: 2870
  Description of Artificial Sequence: Synthetic polypeptide
  XENP022435 [ICOS]_H0_L0.10_Fab-1G6_L1.194_H1.279 scFv-Fc Heavy Chain

SEQ ID NO: 28284 - protein, 214 aa, Artificial Sequence; identical to SEQ ID NO: 27276
  Description of Artificial Sequence: Synthetic polypeptide
  XENP022435 [ICOS]_H0_L0.10_Fab-1G6_L1.194_H1.279 Light Chain

SEQ ID NO: 28285 - protein, 454 aa, Artificial Sequence; identical to SEQ ID NO: 26442
  Description of Artificial Sequence: Synthetic polypeptide
  XENP022436 [ICOS]_H0_L0.14_Fab-1G6_L1.194_H1.279 Fab-Fc Heavy Chain

SEQ ID NO: 28286 - protein, 480 aa, Artificial Sequence; identical to SEQ ID NO: 2870
  Description of Artificial Sequence: Synthetic polypeptide
  XENP022436 [ICOS]_H0_L0.14_Fab-1G6_L1.194_H1.279 scFv-Fc Heavy Chain

SEQ ID NO: 28287 - protein, 214 aa, Artificial Sequence; identical to SEQ ID NO: 27287
  Description of Artificial Sequence: Synthetic polypeptide
  XENP022436 [ICOS]_H0_L0.14_Fab-1G6_L1.194_H1.279 Light Chain

SEQ ID NO: 28288 - protein, 454 aa, Artificial Sequence; identical to SEQ ID NO: 26442
  Description of Artificial Sequence: Synthetic polypeptide
  XENP022437 [ICOS]_H0_L0.15_Fab-1G6_L1.194_H1.279 Fab-Fc Heavy Chain

SEQ ID NO: 28289 - protein, 480 aa, Artificial Sequence; identical to SEQ ID NO: 2870
  Description of Artificial Sequence: Synthetic polypeptide
  XENP022437 [ICOS]_H0_L0.15_Fab-1G6_L1.194_H1.279 scFv-Fc Heavy Chain

SEQ ID NO: 28290 - protein, 214 aa, Artificial Sequence; identical to SEQ ID NO: 27298
  Description of Artificial Sequence: Synthetic polypeptide
  XENP022437 [ICOS]_H0_L0.15_Fab-1G6_L1.194_H1.279 Light Chain

SEQ ID NO: 28291 - protein, 454 aa, Artificial Sequence; identical to SEQ ID NO: 26442
  Description of Artificial Sequence: Synthetic polypeptide
  XENP022438 [ICOS]_H0_L0.20_Fab-1G6_L1.194_H1.279 Fab-Fc Heavy Chain

SEQ ID NO: 28292 - protein, 480 aa, Artificial Sequence; identical to SEQ ID NO: 2870
  Description of Artificial Sequence: Synthetic polypeptide
  XENP022438 [ICOS]_H0_L0.20_Fab-1G6_L1.194_H1.279 scFv-Fc Heavy Chain

SEQ ID NO: 28293 - protein, 214 aa, Artificial Sequence; identical to SEQ ID NO: 27309
  Description of Artificial Sequence: Synthetic polypeptide
  XENP022438 [ICOS]_H0_L0.20_Fab-1G6_L1.194_H1.279 Light Chain

SEQ ID NO: 28294 - protein, 454 aa, Artificial Sequence; identical to SEQ ID NO: 26442
  Description of Artificial Sequence: Synthetic polypeptide
  XENP022731 [ICOS]_H0_L0.21_Fab-1G6_L1.194_H1.279 Fab-Fc Heavy Chain

SEQ ID NO: 28295 - protein, 480 aa, Artificial Sequence; identical to SEQ ID NO: 2870
  Description of Artificial Sequence: Synthetic polypeptide
  XENP022731 [ICOS]_H0_L0.21_Fab-1G6_L1.194_H1.279 scFv-Fc Heavy Chain

SEQ ID NO: 28296 - protein, 214 aa, Artificial Sequence; identical to SEQ ID NO: 27980
  Description of Artificial Sequence: Synthetic polypeptide
  XENP022731 [ICOS]_H0_L0.21_Fab-1G6_L1.194_H1.279 Light Chain

SEQ ID NO: 28297 - protein, 454 aa, Artificial Sequence; identical to SEQ ID NO: 26442
  Description of Artificial Sequence: Synthetic polypeptide
  XENP022732 [ICOS]_H0_L0.22_Fab-1G6_L1.194_H1.279 Fab-Fc Heavy Chain

SEQ ID NO: 28298 - protein, 480 aa, Artificial Sequence; identical to SEQ ID NO: 2870
  Description of Artificial Sequence: Synthetic polypeptide
  XENP022732 [ICOS]_H0_L0.22_Fab-1G6_L1.194_H1.279 scFv-Fc Heavy Chain

SEQ ID NO: 28299 - protein, 214 aa, Artificial Sequence; identical to SEQ ID NO: 27982
  Description of Artificial Sequence: Synthetic polypeptide
  XENP022732 [ICOS]_H0_L0.22_Fab-1G6_L1.194_H1.279 Light Chain

SEQ ID NO: 28300 - protein, 454 aa, Artificial Sequence; identical to SEQ ID NO: 26442
  Description of Artificial Sequence: Synthetic polypeptide
  XENP022733 [ICOS]_H0_L0.23_Fab-1G6_L1.194_H1.279 Fab-Fc Heavy Chain

SEQ ID NO: 28301 - protein, 480 aa, Artificial Sequence; identical to SEQ ID NO: 2870
  Description of Artificial Sequence: Synthetic polypeptide
  XENP022733 [ICOS]_H0_L0.23_Fab-1G6_L1.194_H1.279 scFv-Fc Heavy Chain

SEQ ID NO: 28302 - protein, 214 aa, Artificial Sequence; identical to SEQ ID NO: 27984
  Description of Artificial Sequence: Synthetic polypeptide
  XENP022733 [ICOS]_H0_L0.23_Fab-1G6_L1.194_H1.279 Light Chain

SEQ ID NO: 28303 - protein, 454 aa, Artificial Sequence; identical to SEQ ID NO: 26442
  Description of Artificial Sequence: Synthetic polypeptide
  XENP022734 [ICOS]_H0_L0.24_Fab-1G6_L1.194_H1.279 Fab-Fc Heavy Chain

SEQ ID NO: 28304 - protein, 480 aa, Artificial Sequence; identical to SEQ ID NO: 2870
  Description of Artificial Sequence: Synthetic polypeptide
  XENP022734 [ICOS]_H0_L0.24_Fab-1G6_L1.194_H1.279 scFv-Fc Heavy Chain

SEQ ID NO: 28305 - protein, 214 aa, Artificial Sequence; identical to SEQ ID NO: 27986
  Description of Artificial Sequence: Synthetic polypeptide
  XENP022734 [ICOS]_H0_L0.24_Fab-1G6_L1.194_H1.279 Light Chain

SEQ ID NO: 28306 - protein, 454 aa, Artificial Sequence; identical to SEQ ID NO: 26442
  Description of Artificial Sequence: Synthetic polypeptide
  XENP022735 [ICOS]_H0_L0.25_Fab-1G6_L1.194_H1.279 Fab-Fc Heavy Chain

SEQ ID NO: 28307 - protein, 480 aa, Artificial Sequence; identical to SEQ ID NO: 2870
  Description of Artificial Sequence: Synthetic polypeptide
  XENP022735 [ICOS]_H0_L0.25_Fab-1G6_L1.194_H1.279 scFv-Fc Heavy Chain

SEQ ID NO: 28308 - protein, 214 aa, Artificial Sequence; identical to SEQ ID NO: 27988
  Description of Artificial Sequence: Synthetic polypeptide
  XENP022735 [ICOS]_H0_L0.25_Fab-1G6_L1.194_H1.279 Light Chain

SEQ ID NO: 28309 - protein, 454 aa, Artificial Sequence; identical to SEQ ID NO: 26442
  Description of Artificial Sequence: Synthetic polypeptide
  XENP022736 [ICOS]_H0_L0.26_Fab-1G6_L1.194_H1.279 Fab-Fc Heavy Chain

SEQ ID NO: 28310 - protein, 480 aa, Artificial Sequence; identical to SEQ ID NO: 2870
  Description of Artificial Sequence: Synthetic polypeptide
  XENP022736 [ICOS]_H0_L0.26_Fab-1G6_L1.194_H1.279 scFv-Fc Heavy Chain

SEQ ID NO: 28311 - protein, 214 aa, Artificial Sequence; identical to SEQ ID NO: 27990
  Description of Artificial Sequence: Synthetic polypeptide
  XENP022736 [ICOS]_H0_L0.26_Fab-1G6_L1.194_H1.279 Light Chain

SEQ ID NO: 28312 - protein, 454 aa, Artificial Sequence; identical to SEQ ID NO: 26442
  Description of Artificial Sequence: Synthetic polypeptide
  XENP022737 [ICOS]_H0_L0.27_Fab-1G6_L1.194_H1.279 Fab-Fc Heavy Chain

SEQ ID NO: 28313 - protein, 480 aa, Artificial Sequence; identical to SEQ ID NO: 2870
  Description of Artificial Sequence: Synthetic polypeptide
  XENP022737 [ICOS]_H0_L0.27_Fab-1G6_L1.194_H1.279 scFv-Fc Heavy Chain

SEQ ID NO: 28314 - protein, 214 aa, Artificial Sequence; identical to SEQ ID NO: 27992
  Description of Artificial Sequence: Synthetic polypeptide
  XENP022737 [ICOS]_H0_L0.27_Fab-1G6_L1.194_H1.279 Light Chain

SEQ ID NO: 28315 - protein, 454 aa, Artificial Sequence; identical to SEQ ID NO: 26442
  Description of Artificial Sequence: Synthetic polypeptide
  XENP022738 [ICOS]_H0_L0.28_Fab-1G6_L1.194_H1.279 Fab-Fc Heavy Chain

SEQ ID NO: 28316 - protein, 480 aa, Artificial Sequence; identical to SEQ ID NO: 2870
  Description of Artificial Sequence: Synthetic polypeptide
  XENP022738 [ICOS]_H0_L0.28_Fab-1G6_L1.194_H1.279 scFv-Fc Heavy Chain

SEQ ID NO: 28317 - protein, 214 aa, Artificial Sequence; identical to SEQ ID NO: 27994
  Description of Artificial Sequence: Synthetic polypeptide
  XENP022738 [ICOS]_H0_L0.28_Fab-1G6_L1.194_H1.279 Light Chain

SEQ ID NO: 28318 - protein, 454 aa, Artificial Sequence; identical to SEQ ID NO: 26442
  Description of Artificial Sequence: Synthetic polypeptide
  XENP022739 [ICOS]_H0_L0.29_Fab-1G6_L1.194_H1.279 Fab-Fc Heavy Chain

SEQ ID NO: 28319 - protein, 480 aa, Artificial Sequence; identical to SEQ ID NO: 2870
  Description of Artificial Sequence: Synthetic polypeptide
  XENP022739 [ICOS]_H0_L0.29_Fab-1G6_L1.194_H1.279 scFv-Fc Heavy Chain

SEQ ID NO: 28320 - protein, 214 aa, Artificial Sequence; identical to SEQ ID NO: 27996
  Description of Artificial Sequence: Synthetic polypeptide
  XENP022739 [ICOS]_H0_L0.29_Fab-1G6_L1.194_H1.279 Light Chain

SEQ ID NO: 28321 - protein, 454 aa, Artificial Sequence; identical to SEQ ID NO: 26442
  Description of Artificial Sequence: Synthetic polypeptide
  XENP022740 [ICOS]_H0_L0.30_Fab-1G6_L1.194_H1.279 Fab-Fc Heavy Chain

SEQ ID NO: 28322 - protein, 480 aa, Artificial Sequence; identical to SEQ ID NO: 2870
  Description of Artificial Sequence: Synthetic polypeptide
  XENP022740 [ICOS]_H0_L0.30_Fab-1G6_L1.194_H1.279 scFv-Fc Heavy Chain

SEQ ID NO: 28323 - protein, 214 aa, Artificial Sequence; identical to SEQ ID NO: 27998
  Description of Artificial Sequence: Synthetic polypeptide
  XENP022740 [ICOS]_H0_L0.30_Fab-1G6_L1.194_H1.279 Light Chain

SEQ ID NO: 28324 - protein, 454 aa, Artificial Sequence; identical to SEQ ID NO: 26442
  Description of Artificial Sequence: Synthetic polypeptide
  XENP022741 [ICOS]_H0_L0.31_Fab-1G6_L1.194_H1.279 Fab-Fc Heavy Chain

SEQ ID NO: 28325 - protein, 480 aa, Artificial Sequence; identical to SEQ ID NO: 2870
  Description of Artificial Sequence: Synthetic polypeptide
  XENP022741 [ICOS]_H0_L0.31_Fab-1G6_L1.194_H1.279 scFv-Fc Heavy Chain

SEQ ID NO: 28326 - protein, 214 aa, Artificial Sequence; identical to SEQ ID NO: 28000
  Description of Artificial Sequence: Synthetic polypeptide
  XENP022741 [ICOS]_H0_L0.31_Fab-1G6_L1.194_H1.279 Light Chain

SEQ ID NO: 28327 - protein, 454 aa, Artificial Sequence; identical to SEQ ID NO: 26442
  Description of Artificial Sequence: Synthetic polypeptide
  XENP022742 [ICOS]_H0_L0.32_Fab-1G6_L1.194_H1.279 Fab-Fc Heavy Chain

SEQ ID NO: 28328 - protein, 480 aa, Artificial Sequence; identical to SEQ ID NO: 2870
  Description of Artificial Sequence: Synthetic polypeptide
  XENP022742 [ICOS]_H0_L0.32_Fab-1G6_L1.194_H1.279 scFv-Fc Heavy Chain

SEQ ID NO: 28329 - protein, 214 aa, Artificial Sequence; identical to SEQ ID NO: 28002
  Description of Artificial Sequence: Synthetic polypeptide
  XENP022742 [ICOS]_H0_L0.32_Fab-1G6_L1.194_H1.279 Light Chain

SEQ ID NO: 28330 - protein, 454 aa, Artificial Sequence; identical to SEQ ID NO: 26442
  Description of Artificial Sequence: Synthetic polypeptide
  XENP022743 [ICOS]_H0_L0.33_Fab-1G6_L1.194_H1.279 Fab-Fc Heavy Chain

SEQ ID NO: 28331 - protein, 480 aa, Artificial Sequence; identical to SEQ ID NO: 2870
  Description of Artificial Sequence: Synthetic polypeptide
  XENP022743 [ICOS]_H0_L0.33_Fab-1G6_L1.194_H1.279 scFv-Fc Heavy Chain

SEQ ID NO: 28332 - protein, 214 aa, Artificial Sequence; identical to SEQ ID NO: 28004
  Description of Artificial Sequence: Synthetic polypeptide
  XENP022743 [ICOS]_H0_L0.33_Fab-1G6_L1.194_H1.279 Light Chain

SEQ ID NO: 28333 - protein, 454 aa, Artificial Sequence; identical to SEQ ID NO: 26442
  Description of Artificial Sequence: Synthetic polypeptide
  XENP022744 [ICOS]_H0_L0.34_Fab-1G6_L1.194_H1.279 Fab-Fc Heavy Chain

SEQ ID NO: 28334 - protein, 480 aa, Artificial Sequence; identical to SEQ ID NO: 2870
  Description of Artificial Sequence: Synthetic polypeptide
  XENP022744 [ICOS]_H0_L0.34_Fab-1G6_L1.194_H1.279 scFv-Fc Heavy Chain

SEQ ID NO: 28335 - protein, 214 aa, Artificial Sequence; identical to SEQ ID NO: 26497
  Description of Artificial Sequence: Synthetic polypeptide
  XENP022744 [ICOS]_H0_L0.34_Fab-1G6_L1.194_H1.279 Light Chain

SEQ ID NO: 28336 - protein, 454 aa, Artificial Sequence; identical to SEQ ID NO: 26442
  Description of Artificial Sequence: Synthetic polypeptide
  XENP022745 [ICOS]_H0_L0.35_Fab-1G6_L1.194_H1.279 Fab-Fc Heavy Chain

SEQ ID NO: 28337 - protein, 480 aa, Artificial Sequence; identical to SEQ ID NO: 2870
  Description of Artificial Sequence: Synthetic polypeptide
  XENP022745 [ICOS]_H0_L0.35_Fab-1G6_L1.194_H1.279 scFv-Fc Heavy Chain

SEQ ID NO: 28338 - protein, 214 aa, Artificial Sequence; identical to SEQ ID NO: 28008
  Description of Artificial Sequence: Synthetic polypeptide
  XENP022745 [ICOS]_H0_L0.35_Fab-1G6_L1.194_H1.279 Light Chain

SEQ ID NO: 28339 - protein, 454 aa, Artificial Sequence; identical to SEQ ID NO: 26442
  Description of Artificial Sequence: Synthetic polypeptide
  XENP022746 [ICOS]_H0_L0.36_Fab-1G6_L1.194_H1.279 Fab-Fc Heavy Chain

SEQ ID NO: 28340 - protein, 480 aa, Artificial Sequence; identical to SEQ ID NO: 2870
  Description of Artificial Sequence: Synthetic polypeptide
  XENP022746 [ICOS]_H0_L0.36_Fab-1G6_L1.194_H1.279 scFv-Fc Heavy Chain

SEQ ID NO: 28341 - protein, 214 aa, Artificial Sequence; identical to SEQ ID NO: 26517
  Description of Artificial Sequence: Synthetic polypeptide
  XENP022746 [ICOS]_H0_L0.36_Fab-1G6_L1.194_H1.279 Light Chain

SEQ ID NO: 28342 - protein, 454 aa, Artificial Sequence; identical to SEQ ID NO: 26442
  Description of Artificial Sequence: Synthetic polypeptide
  XENP022747 [ICOS]_H0_L0.37_Fab-1G6_L1.194_H1.279 Fab-Fc Heavy Chain

SEQ ID NO: 28343 - protein, 480 aa, Artificial Sequence; identical to SEQ ID NO: 2870
  Description of Artificial Sequence: Synthetic polypeptide
  XENP022747 [ICOS]_H0_L0.37_Fab-1G6_L1.194_H1.279 scFv-Fc Heavy Chain

SEQ ID NO: 28344 - protein, 214 aa, Artificial Sequence; identical to SEQ ID NO: 26537
  Description of Artificial Sequence: Synthetic polypeptide
  XENP022747 [ICOS]_H0_L0.37_Fab-1G6_L1.194_H1.279 Light Chain

SEQ ID NO: 28345 - protein, 454 aa, Artificial Sequence; identical to SEQ ID NO: 26442
  Description of Artificial Sequence: Synthetic polypeptide
  XENP022748 [ICOS]_H0_L0.38_Fab-1G6_L1.194_H1.279 Fab-Fc Heavy Chain

SEQ ID NO: 28346 - protein, 480 aa, Artificial Sequence; identical to SEQ ID NO: 2870
  Description of Artificial Sequence: Synthetic polypeptide
  XENP022748 [ICOS]_H0_L0.38_Fab-1G6_L1.194_H1.279 scFv-Fc Heavy Chain

SEQ ID NO: 28347 - protein, 214 aa, Artificial Sequence; identical to SEQ ID NO: 26557
  Description of Artificial Sequence: Synthetic polypeptide
  XENP022748 [ICOS]_H0_L0.38_Fab-1G6_L1.194_H1.279 Light Chain

SEQ ID NO: 28348 - protein, 454 aa, Artificial Sequence; identical to SEQ ID NO: 26442
  Description of Artificial Sequence: Synthetic polypeptide
  XENP022878 [ICOS]_H0_L0.42_Fab-1G6_L1.194_H1.279 Fab-Fc Heavy Chain

SEQ ID NO: 28349 - protein, 480 aa, Artificial Sequence; identical to SEQ ID NO: 2870
  Description of Artificial Sequence: Synthetic polypeptide
  XENP022878 [ICOS]_H0_L0.42_Fab-1G6_L1.194_H1.279 scFv-Fc Heavy Chain

SEQ ID NO: 28350 - protein, 214 aa, Artificial Sequence; identical to SEQ ID NO: 28016
  Description of Artificial Sequence: Synthetic polypeptide
  XENP022878 [ICOS]_H0_L0.42_Fab-1G6_L1.194_H1.279 Light Chain

SEQ ID NO: 28351 - protein, 454 aa, Artificial Sequence; identical to SEQ ID NO: 26442
  Description of Artificial Sequence: Synthetic polypeptide
  XENP022879 [ICOS]_H0_L0.43_Fab-1G6_L1.194_H1.279 Fab-Fc Heavy Chain

SEQ ID NO: 28352 - protein, 480 aa, Artificial Sequence; identical to SEQ ID NO: 2870
  Description of Artificial Sequence: Synthetic polypeptide
  XENP022879 [ICOS]_H0_L0.43_Fab-1G6_L1.194_H1.279 scFv-Fc Heavy Chain

SEQ ID NO: 28353 - protein, 214 aa, Artificial Sequence; identical to SEQ ID NO: 28018
  Description of Artificial Sequence: Synthetic polypeptide
  XENP022879 [ICOS]_H0_L0.43_Fab-1G6_L1.194_H1.279 Light Chain

SEQ ID NO: 28354 - protein, 454 aa, Artificial Sequence; identical to SEQ ID NO: 26442
  Description of Artificial Sequence: Synthetic polypeptide
  XENP022880 [ICOS]_H0_L0.44_Fab-1G6_L1.194_H1.279 Fab-Fc Heavy Chain

SEQ ID NO: 28355 - protein, 480 aa, Artificial Sequence; identical to SEQ ID NO: 2870
  Description of Artificial Sequence: Synthetic polypeptide
  XENP022880 [ICOS]_H0_L0.44_Fab-1G6_L1.194_H1.279 scFv-Fc Heavy Chain

SEQ ID NO: 28356 - protein, 214 aa, Artificial Sequence; identical to SEQ ID NO: 28020
  Description of Artificial Sequence: Synthetic polypeptide
  XENP022880 [ICOS]_H0_L0.44_Fab-1G6_L1.194_H1.279 Light Chain

SEQ ID NO: 28357 - protein, 454 aa, Artificial Sequence; identical to SEQ ID NO: 28174
  Description of Artificial Sequence: Synthetic polypeptide
  XENP022881 [ICOS]_H0.35_L0.38_Fab-1G6_L1.194_H1.279 Fab-Fc Heavy Chain

SEQ ID NO: 28358 - protein, 480 aa, Artificial Sequence; identical to SEQ ID NO: 2870
  Description of Artificial Sequence: Synthetic polypeptide
  XENP022881 [ICOS]_H0.35_L0.38_Fab-1G6_L1.194_H1.279 scFv-Fc Heavy Chain

SEQ ID NO: 28359 - protein, 214 aa, Artificial Sequence; identical to SEQ ID NO: 26557
  Description of Artificial Sequence: Synthetic polypeptide
  XENP022881 [ICOS]_H0.35_L0.38_Fab-1G6_L1.194_H1.279 Light Chain

SEQ ID NO: 28360 - protein, 454 aa, Artificial Sequence; identical to SEQ ID NO: 28174
  Description of Artificial Sequence: Synthetic polypeptide
  XENP022882 [ICOS]_H0.35_L0.42_Fab-1G6_L1.194_H1.279 Fab-Fc Heavy Chain

SEQ ID NO: 28361 - protein, 480 aa, Artificial Sequence; identical to SEQ ID NO: 2870
  Description of Artificial Sequence: Synthetic polypeptide
  XENP022882 [ICOS]_H0.35_L0.42_Fab-1G6_L1.194_H1.279 scFv-Fc Heavy Chain

SEQ ID NO: 28362 - protein, 214 aa, Artificial Sequence; identical to SEQ ID NO: 28016
  Description of Artificial Sequence: Synthetic polypeptide
  XENP022882 [ICOS]_H0.35_L0.42_Fab-1G6_L1.194_H1.279 Light Chain

SEQ ID NO: 28363 - protein, 454 aa, Artificial Sequence; identical to SEQ ID NO: 28174
  Description of Artificial Sequence: Synthetic polypeptide
  XENP022883 [ICOS]_H0.35_L0.43_Fab-1G6_L1.194_H1.279 Fab-Fc Heavy Chain

SEQ ID NO: 28364 - protein, 480 aa, Artificial Sequence; identical to SEQ ID NO: 2870
  Description of Artificial Sequence: Synthetic polypeptide
  XENP022883 [ICOS]_H0.35_L0.43_Fab-1G6_L1.194_H1.279 scFv-Fc Heavy Chain

SEQ ID NO: 28365 - protein, 214 aa, Artificial Sequence; identical to SEQ ID NO: 28018
  Description of Artificial Sequence: Synthetic polypeptide
  XENP022883 [ICOS]_H0.35_L0.43_Fab-1G6_L1.194_H1.279 Light Chain

SEQ ID NO: 28366 - protein, 454 aa, Artificial Sequence; identical to SEQ ID NO: 28174
  Description of Artificial Sequence: Synthetic polypeptide
  XENP022884 [ICOS]_H0.35_L0.44_Fab-1G6_L1.194_H1.279 Fab-Fc Heavy Chain

SEQ ID NO: 28367 - protein, 480 aa, Artificial Sequence; identical to SEQ ID NO: 2870
  Description of Artificial Sequence: Synthetic polypeptide
  XENP022884 [ICOS]_H0.35_L0.44_Fab-1G6_L1.194_H1.279 scFv-Fc Heavy Chain

SEQ ID NO: 28368 - protein, 214 aa, Artificial Sequence; identical to SEQ ID NO: 28020
  Description of Artificial Sequence: Synthetic polypeptide
  XENP022884 [ICOS]_H0.35_L0.44_Fab-1G6_L1.194_H1.279 Light Chain

SEQ ID NO: 28369 - protein, 454 aa, Artificial Sequence; identical to SEQ ID NO: 28186
  Description of Artificial Sequence: Synthetic polypeptide
  XENP022885 [ICOS]_H0.61_L0.38_Fab-1G6_L1.194_H1.279 Fab-Fc Heavy Chain

SEQ ID NO: 28370 - protein, 480 aa, Artificial Sequence; identical to SEQ ID NO: 2870
  Description of Artificial Sequence: Synthetic polypeptide
  XENP022885 [ICOS]_H0.61_L0.38_Fab-1G6_L1.194_H1.279 scFv-Fc Heavy Chain

SEQ ID NO: 28371 - protein, 214 aa, Artificial Sequence; identical to SEQ ID NO: 26557
  Description of Artificial Sequence: Synthetic polypeptide
  XENP022885 [ICOS]_H0.61_L0.38_Fab-1G6_L1.194_H1.279 Light Chain

SEQ ID NO: 28372 - protein, 454 aa, Artificial Sequence; identical to SEQ ID NO: 28186
  Description of Artificial Sequence: Synthetic polypeptide
  XENP022886 [ICOS]_H0.61_L0.42_Fab-1G6_L1.194_H1.279 Fab-Fc Heavy Chain

SEQ ID NO: 28373 - protein, 480 aa, Artificial Sequence; identical to SEQ ID NO: 2870
  Description of Artificial Sequence: Synthetic polypeptide
  XENP022886 [ICOS]_H0.61_L0.42_Fab-1G6_L1.194_H1.279 scFv-Fc Heavy Chain

SEQ ID NO: 28374 - protein, 214 aa, Artificial Sequence; identical to SEQ ID NO: 28016
  Description of Artificial Sequence: Synthetic polypeptide
  XENP022886 [ICOS]_H0.61_L0.42_Fab-1G6_L1.194_H1.279 Light Chain

SEQ ID NO: 28375 - protein, 454 aa, Artificial Sequence; identical to SEQ ID NO: 28186
  Description of Artificial Sequence: Synthetic polypeptide
  XENP022887 [ICOS]_H0.61_L0.43_Fab-1G6_L1.194_H1.279 Fab-Fc Heavy Chain

SEQ ID NO: 28376 - protein, 480 aa, Artificial Sequence; identical to SEQ ID NO: 2870
  Description of Artificial Sequence: Synthetic polypeptide
  XENP022887 [ICOS]_H0.61_L0.43_Fab-1G6_L1.194_H1.279 scFv-Fc Heavy Chain

SEQ ID NO: 28377 - protein, 214 aa, Artificial Sequence; identical to SEQ ID NO: 28018
  Description of Artificial Sequence: Synthetic polypeptide
  XENP022887 [ICOS]_H0.61_L0.43_Fab-1G6_L1.194_H1.279 Light Chain

SEQ ID NO: 28378 - protein, 454 aa, Artificial Sequence; identical to SEQ ID NO: 28186
  Description of Artificial Sequence: Synthetic polypeptide
  XENP022888 [ICOS]_H0.61_L0.44_Fab-1G6_L1.194_H1.279 Fab-Fc Heavy Chain

SEQ ID NO: 28379 - protein, 480 aa, Artificial Sequence; identical to SEQ ID NO: 2870
  Description of Artificial Sequence: Synthetic polypeptide
  XENP022888 [ICOS]_H0.61_L0.44_Fab-1G6_L1.194_H1.279 scFv-Fc Heavy Chain

SEQ ID NO: 28380 - protein, 214 aa, Artificial Sequence; identical to SEQ ID NO: 28020
  Description of Artificial Sequence: Synthetic polypeptide
  XENP022888 [ICOS]_H0.61_L0.44_Fab-1G6_L1.194_H1.279 Light Chain

SEQ ID NO: 28381 - protein, 454 aa, Artificial Sequence; identical to SEQ ID NO: 28198
  Description of Artificial Sequence: Synthetic polypeptide
  XENP022889 [ICOS]_H0.24_L0.38_Fab-1G6_L1.194_H1.279 Fab-Fc Heavy Chain

SEQ ID NO: 28382 - protein, 480 aa, Artificial Sequence; identical to SEQ ID NO: 2870
  Description of Artificial Sequence: Synthetic polypeptide
  XENP022889 [ICOS]_H0.24_L0.38_Fab-1G6_L1.194_H1.279 scFv-Fc Heavy Chain

SEQ ID NO: 28383 - protein, 214 aa, Artificial Sequence; identical to SEQ ID NO: 26557
  Description of Artificial Sequence: Synthetic polypeptide
  XENP022889 [ICOS]_H0.24_L0.38_Fab-1G6_L1.194_H1.279 Light Chain

SEQ ID NO: 28384 - protein, 454 aa, Artificial Sequence; identical to SEQ ID NO: 28201
  Description of Artificial Sequence: Synthetic polypeptide
  XENP022890 [ICOS]_H0.37_L0.38_Fab-1G6_L1.194_H1.279 Fab-Fc Heavy Chain

SEQ ID NO: 28385 - protein, 480 aa, Artificial Sequence; identical to SEQ ID NO: 2870
  Description of Artificial Sequence: Synthetic polypeptide
  XENP022890 [ICOS]_H0.37_L0.38_Fab-1G6_L1.194_H1.279 scFv-Fc Heavy Chain

SEQ ID NO: 28386 - protein, 214 aa, Artificial Sequence; identical to SEQ ID NO: 26557
  Description of Artificial Sequence: Synthetic polypeptide
  XENP022890 [ICOS]_H0.37_L0.38_Fab-1G6_L1.194_H1.279 Light Chain

SEQ ID NO: 28387 - protein, 454 aa, Artificial Sequence; identical to SEQ ID NO: 28204
  Description of Artificial Sequence: Synthetic polypeptide
  XENP022891 [ICOS]_H0.40_L0.38_Fab-1G6_L1.194_H1.279 Fab-Fc Heavy Chain

SEQ ID NO: 28388 - protein, 480 aa, Artificial Sequence; identical to SEQ ID NO: 2870
  Description of Artificial Sequence: Synthetic polypeptide
  XENP022891 [ICOS]_H0.40_L0.38_Fab-1G6_L1.194_H1.279 scFv-Fc Heavy Chain

SEQ ID NO: 28389 - protein, 214 aa, Artificial Sequence; identical to SEQ ID NO: 26557
  Description of Artificial Sequence: Synthetic polypeptide
  XENP022891 [ICOS]_H0.40_L0.38_Fab-1G6_L1.194_H1.279 Light Chain

SEQ ID NO: 28390 - protein, 454 aa, Artificial Sequence; identical to SEQ ID NO: 28207
  Description of Artificial Sequence: Synthetic polypeptide
  XENP022892 [ICOS]_H0.44_L0.38_Fab-1G6_L1.194_H1.279 Fab-Fc Heavy Chain

SEQ ID NO: 28391 - protein, 480 aa, Artificial Sequence; identical to SEQ ID NO: 2870
  Description of Artificial Sequence: Synthetic polypeptide
  XENP022892 [ICOS]_H0.44_L0.38_Fab-1G6_L1.194_H1.279 scFv-Fc Heavy Chain

SEQ ID NO: 28392 - protein, 214 aa, Artificial Sequence; identical to SEQ ID NO: 26557
  Description of Artificial Sequence: Synthetic polypeptide
  XENP022892 [ICOS]_H0.44_L0.38_Fab-1G6_L1.194_H1.279 Light Chain

SEQ ID NO: 28393 - protein, 454 aa, Artificial Sequence; identical to SEQ ID NO: 28210
  Description of Artificial Sequence: Synthetic polypeptide
  XENP022893 [ICOS]_H0.56_L0.38_Fab-1G6_L1.194_H1.279 Fab-Fc Heavy Chain

SEQ ID NO: 28394 - protein, 480 aa, Artificial Sequence; identical to SEQ ID NO: 2870
  Description of Artificial Sequence: Synthetic polypeptide
  XENP022893 [ICOS]_H0.56_L0.38_Fab-1G6_L1.194_H1.279 scFv-Fc Heavy Chain

SEQ ID NO: 28395 - protein, 214 aa, Artificial Sequence; identical to SEQ ID NO: 26557
  Description of Artificial Sequence: Synthetic polypeptide
  XENP022893 [ICOS]_H0.56_L0.38_Fab-1G6_L1.194_H1.279 Light Chain

SEQ ID NO: 28396 - protein, 454 aa, Artificial Sequence; identical to SEQ ID NO: 28213
  Description of Artificial Sequence: Synthetic polypeptide
  XENP022894 [ICOS]_H0.62_L0.38_Fab-1G6_L1.194_H1.279 Fab-Fc Heavy Chain

SEQ ID NO: 28397 - protein, 480 aa, Artificial Sequence; identical to SEQ ID NO: 2870
  Description of Artificial Sequence: Synthetic polypeptide
  XENP022894 [ICOS]_H0.62_L0.38_Fab-1G6_L1.194_H1.279 scFv-Fc Heavy Chain

SEQ ID NO: 28398 - protein, 214 aa, Artificial Sequence; identical to SEQ ID NO: 26557
  Description of Artificial Sequence: Synthetic polypeptide
  XENP022894 [ICOS]_H0.62_L0.38_Fab-1G6_L1.194_H1.279 Light Chain

SEQ ID NO: 28399 - protein, 454 aa, Artificial Sequence; identical to SEQ ID NO: 28174
  Description of Artificial Sequence: Synthetic polypeptide
  XENP022931 [ICOS]_H0.35_L0.36_Fab-1G6_L1.194_H1.279 Fab-Fc Heavy Chain

SEQ ID NO: 28400 - protein, 480 aa, Artificial Sequence; identical to SEQ ID NO: 2870
  Description of Artificial Sequence: Synthetic polypeptide
  XENP022931 [ICOS]_H0.35_L0.36_Fab-1G6_L1.194_H1.279 scFv-Fc Heavy Chain

SEQ ID NO: 28401 - protein, 214 aa, Artificial Sequence; identical to SEQ ID NO: 26517
  Description of Artificial Sequence: Synthetic polypeptide
  XENP022931 [ICOS]_H0.35_L0.36_Fab-1G6_L1.194_H1.279 Light Chain

SEQ ID NO: 28402 - protein, 454 aa, Artificial Sequence; identical to SEQ ID NO: 28186
  Description of Artificial Sequence: Synthetic polypeptide
  XENP022932 [ICOS]_H0.61_L0.36_Fab-1G6_L1.194_H1.279 Fab-Fc Heavy Chain

SEQ ID NO: 28403 - protein, 480 aa, Artificial Sequence; identical to SEQ ID NO: 2870
  Description of Artificial Sequence: Synthetic polypeptide
  XENP022932 [ICOS]_H0.61_L0.36_Fab-1G6_L1.194_H1.279 scFv-Fc Heavy Chain

SEQ ID NO: 28404 - protein, 214 aa, Artificial Sequence; identical to SEQ ID NO: 26517
  Description of Artificial Sequence: Synthetic polypeptide
  XENP022932 [ICOS]_H0.61_L0.36_Fab-1G6_L1.194_H1.279 Light Chain

SEQ ID NO: 28405 - protein, 454 aa, Artificial Sequence; identical to SEQ ID NO: 26362
  Description of Artificial Sequence: Synthetic polypeptide
  XENP022935 [ICOS]_H0_L0.36_Fab-1G6_L1.194_H1.279 Fab-Fc Heavy Chain

SEQ ID NO: 28406 - protein, 480 aa, Artificial Sequence; identical to SEQ ID NO: 2930
  Description of Artificial Sequence: Synthetic polypeptide
  XENP022935 [ICOS]_H0_L0.36_Fab-1G6_L1.194_H1.279 scFv-Fc Heavy Chain

SEQ ID NO: 28407 - protein, 214 aa, Artificial Sequence; identical to SEQ ID NO: 26517
  Description of Artificial Sequence: Synthetic polypeptide
  XENP022935 [ICOS]_H0_L0.36_Fab-1G6_L1.194_H1.279 Light Chain

SEQ ID NO: 28408 - protein, 454 aa, Artificial Sequence
  Description of Artificial Sequence: Synthetic polypeptide
  XENP022936 [ICOS]_H0.35_L0.36_Fab-1G6_L1.194_H1.279 Fab-Fc Heavy Chain
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 28409 - protein, 480 aa, Artificial Sequence; identical to SEQ ID NO: 2930
  Description of Artificial Sequence: Synthetic polypeptide
  XENP022936 [ICOS]_H0.35_L0.36_Fab-1G6_L1.194_H1.279 scFv-Fc Heavy Chain

SEQ ID NO: 28410 - protein, 214 aa, Artificial Sequence; identical to SEQ ID NO: 26517
  Description of Artificial Sequence: Synthetic polypeptide
  XENP022936 [ICOS]_H0.35_L0.36_Fab-1G6_L1.194_H1.279 Light Chain

SEQ ID NO: 28411 - protein, 454 aa, Artificial Sequence
  Description of Artificial Sequence: Synthetic polypeptide
  XENP022937 [ICOS]_H0.61_L0.36_Fab-1G6_L1.194_H1.279 Fab-Fc Heavy Chain
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 28412 - protein, 480 aa, Artificial Sequence; identical to SEQ ID NO: 2930
  Description of Artificial Sequence: Synthetic polypeptide
  XENP022937 [ICOS]_H0.61_L0.36_Fab-1G6_L1.194_H1.279 scFv-Fc Heavy Chain

SEQ ID NO: 28413 - protein, 214 aa, Artificial Sequence; identical to SEQ ID NO: 26517
  Description of Artificial Sequence: Synthetic polypeptide
  XENP022937 [ICOS]_H0.61_L0.36_Fab-1G6_L1.194_H1.279 Light Chain

SEQ ID NO: 28414 - protein, 454 aa, Artificial Sequence; identical to SEQ ID NO: 28198
  Description of Artificial Sequence: Synthetic polypeptide
  XENP022950 [ICOS]_H0.24_L0.37_Fab-1G6_L1.194_H1.279 Fab-Fc Heavy Chain

SEQ ID NO: 28415 - protein, 480 aa, Artificial Sequence; identical to SEQ ID NO: 2870
  Description of Artificial Sequence: Synthetic polypeptide
  XENP022950 [ICOS]_H0.24_L0.37_Fab-1G6_L1.194_H1.279 scFv-Fc Heavy Chain

SEQ ID NO: 28416 - protein, 214 aa, Artificial Sequence; identical to SEQ ID NO: 26537
  Description of Artificial Sequence: Synthetic polypeptide
  XENP022950 [ICOS]_H0.24_L0.37_Fab-1G6_L1.194_H1.279 Light Chain

SEQ ID NO: 28417 - protein, 454 aa, Artificial Sequence; identical to SEQ ID NO: 28201
  Description of Artificial Sequence: Synthetic polypeptide
  XENP022951 [ICOS]_H0.37_L0.37_Fab-1G6_L1.194_H1.279 Fab-Fc Heavy Chain

SEQ ID NO: 28418 - protein, 480 aa, Artificial Sequence; identical to SEQ ID NO: 2870
  Description of Artificial Sequence: Synthetic polypeptide
  XENP022951 [ICOS]_H0.37_L0.37_Fab-1G6_L1.194_H1.279 scFv-Fc Heavy Chain

SEQ ID NO: 28419 - protein, 214 aa, Artificial Sequence; identical to SEQ ID NO: 26537
  Description of Artificial Sequence: Synthetic polypeptide
  XENP022951 [ICOS]_H0.37_L0.37_Fab-1G6_L1.194_H1.279 Light Chain

SEQ ID NO: 28420 - protein, 454 aa, Artificial Sequence; identical to SEQ ID NO: 28204
  Description of Artificial Sequence: Synthetic polypeptide
  XENP022952 [ICOS]_H0.40_L0.37_Fab-1G6_L1.194_H1.279 Fab-Fc Heavy Chain

SEQ ID NO: 28421 - protein, 480 aa, Artificial Sequence; identical to SEQ ID NO: 2870
  Description of Artificial Sequence: Synthetic polypeptide
  XENP022952 [ICOS]_H0.40_L0.37_Fab-1G6_L1.194_H1.279 scFv-Fc Heavy Chain

SEQ ID NO: 28422 - protein, 214 aa, Artificial Sequence; identical to SEQ ID NO: 26537
  Description of Artificial Sequence: Synthetic polypeptide
  XENP022952 [ICOS]_H0.40_L0.37_Fab-1G6_L1.194_H1.279 Light Chain

SEQ ID NO: 28423 - protein, 454 aa, Artificial Sequence; identical to SEQ ID NO: 28207
  Description of Artificial Sequence: Synthetic polypeptide
  XENP022953 [ICOS]_H0.44_L0.37_Fab-1G6_L1.194_H1.279 Fab-Fc Heavy Chain

SEQ ID NO: 28424 - protein, 480 aa, Artificial Sequence; identical to SEQ ID NO: 2870
  Description of Artificial Sequence: Synthetic polypeptide
  XENP022953 [ICOS]_H0.44_L0.37_Fab-1G6_L1.194_H1.279 scFv-Fc Heavy Chain

SEQ ID NO: 28425 - protein, 214 aa, Artificial Sequence; identical to SEQ ID NO: 26537
  Description of Artificial Sequence: Synthetic polypeptide
  XENP022953 [ICOS]_H0.44_L0.37_Fab-1G6_L1.194_H1.279 Light Chain

SEQ ID NO: 28426 - protein, 454 aa, Artificial Sequence; identical to SEQ ID NO: 28210
  Description of Artificial Sequence: Synthetic polypeptide
  XENP022954 [ICOS]_H0.56_L0.37_Fab-1G6_L1.194_H1.279 Fab-Fc Heavy Chain

SEQ ID NO: 28427 - protein, 480 aa, Artificial Sequence; identical to SEQ ID NO: 2870
  Description of Artificial Sequence: Synthetic polypeptide
  XENP022954 [ICOS]_H0.56_L0.37_Fab-1G6_L1.194_H1.279 scFv-Fc Heavy Chain

SEQ ID NO: 28428 - protein, 214 aa, Artificial Sequence; identical to SEQ ID NO: 26537
  Description of Artificial Sequence: Synthetic polypeptide
  XENP022954 [ICOS]_H0.56_L0.37_Fab-1G6_L1.194_H1.279 Light Chain

SEQ ID NO: 28429 - protein, 454 aa, Artificial Sequence; identical to SEQ ID NO: 28213
  Description of Artificial Sequence: Synthetic polypeptide
  XENP022955 [ICOS]_H0.62_L0.37_Fab-1G6_L1.194_H1.279 Fab-Fc Heavy Chain

SEQ ID NO: 28430 - protein, 480 aa, Artificial Sequence; identical to SEQ ID NO: 2870
  Description of Artificial Sequence: Synthetic polypeptide
  XENP022955 [ICOS]_H0.62_L0.37_Fab-1G6_L1.194_H1.279 scFv-Fc Heavy Chain

SEQ ID NO: 28431 - protein, 214 aa, Artificial Sequence; identical to SEQ ID NO: 26537
  Description of Artificial Sequence: Synthetic polypeptide
  XENP022955 [ICOS]_H0.62_L0.37_Fab-1G6_L1.194_H1.279 Light Chain

SEQ ID NO: 28432 - protein, 454 aa, Artificial Sequence; identical to SEQ ID NO: 28174
  Description of Artificial Sequence: Synthetic polypeptide
  XENP022956 [ICOS]_H0.35_L0.34_Fab-1G6_L1.194_H1.279 Fab-Fc Heavy Chain

SEQ ID NO: 28433 - protein, 480 aa, Artificial Sequence; identical to SEQ ID NO: 2870
  Description of Artificial Sequence: Synthetic polypeptide
  XENP022956 [ICOS]_H0.35_L0.34_Fab-1G6_L1.194_H1.279 scFv-Fc Heavy Chain

SEQ ID NO: 28434 - protein, 214 aa, Artificial Sequence; identical to SEQ ID NO: 26497
  Description of Artificial Sequence: Synthetic polypeptide
  XENP022956 [ICOS]_H0.35_L0.34_Fab-1G6_L1.194_H1.279 Light Chain

SEQ ID NO: 28435 - protein, 454 aa, Artificial Sequence; identical to SEQ ID NO: 28174
  Description of Artificial Sequence: Synthetic polypeptide
  XENP022957 [ICOS]_H0.35_L0.35_Fab-1G6_L1.194_H1.279 Fab-Fc Heavy Chain

SEQ ID NO: 28436 - protein, 480 aa, Artificial Sequence; identical to SEQ ID NO: 2870
  Description of Artificial Sequence: Synthetic polypeptide
  XENP022957 [ICOS]_H0.35_L0.35_Fab-1G6_L1.194_H1.279 scFv-Fc Heavy Chain

SEQ ID NO: 28437 - protein, 214 aa, Artificial Sequence; identical to SEQ ID NO: 28008
  Description of Artificial Sequence: Synthetic polypeptide
  XENP022957 [ICOS]_H0.35_L0.35_Fab-1G6_L1.194_H1.279 Light Chain

SEQ ID NO: 28438 - protein, 454 aa, Artificial Sequence; identical to SEQ ID NO: 28174
  Description of Artificial Sequence: Synthetic polypeptide
  XENP022958 [ICOS]_H0.35_L0.37_Fab-1G6_L1.194_H1.279 Fab-Fc Heavy Chain

SEQ ID NO: 28439 - protein, 480 aa, Artificial Sequence; identical to SEQ ID NO: 2870
  Description of Artificial Sequence: Synthetic polypeptide
  XENP022958 [ICOS]_H0.35_L0.37_Fab-1G6_L1.194_H1.279 scFv-Fc Heavy Chain

SEQ ID NO: 28440 - protein, 214 aa, Artificial Sequence; identical to SEQ ID NO: 26537
  Description of Artificial Sequence: Synthetic polypeptide
  XENP022958 [ICOS]_H0.35_L0.37_Fab-1G6_L1.194_H1.279 Light Chain

SEQ ID NO: 28441 - protein, 454 aa, Artificial Sequence; identical to SEQ ID NO: 28186
  Description of Artificial Sequence: Synthetic polypeptide
  XENP022959 [ICOS]_H0.61_L0.34_Fab-1G6_L1.194_H1.279 Fab-Fc Heavy Chain

SEQ ID NO: 28442 - protein, 480 aa, Artificial Sequence; identical to SEQ ID NO: 2870
  Description of Artificial Sequence: Synthetic polypeptide
  XENP022959 [ICOS]_H0.61_L0.34_Fab-1G6_L1.194_H1.279 scFv-Fc Heavy Chain

SEQ ID NO: 28443 - protein, 214 aa, Artificial Sequence; identical to SEQ ID NO: 26497
  Description of Artificial Sequence: Synthetic polypeptide
  XENP022959 [ICOS]_H0.61_L0.34_Fab-1G6_L1.194_H1.279 Light Chain

SEQ ID NO: 28444 - protein, 454 aa, Artificial Sequence; identical to SEQ ID NO: 28186
  Description of Artificial Sequence: Synthetic polypeptide
  XENP022960 [ICOS]_H0.61_L0.35_Fab-1G6_L1.194_H1.279 Fab-Fc Heavy Chain

SEQ ID NO: 28445 - protein, 480 aa, Artificial Sequence; identical to SEQ ID NO: 2870
  Description of Artificial Sequence: Synthetic polypeptide
  XENP022960 [ICOS]_H0.61_L0.35_Fab-1G6_L1.194_H1.279 scFv-Fc Heavy Chain

SEQ ID NO: 28446 - protein, 214 aa, Artificial Sequence; identical to SEQ ID NO: 28008
  Description of Artificial Sequence: Synthetic polypeptide
  XENP022960 [ICOS]_H0.61_L0.35_Fab-1G6_L1.194_H1.279 Light Chain

SEQ ID NO: 28447 - protein, 454 aa, Artificial Sequence; identical to SEQ ID NO: 28186
  Description of Artificial Sequence: Synthetic polypeptide
  XENP022961 [ICOS]_H0.61_L0.37_Fab-1G6_L1.194_H1.279 Fab-Fc Heavy Chain

SEQ ID NO: 28448 - protein, 480 aa, Artificial Sequence; identical to SEQ ID NO: 2870
  Description of Artificial Sequence: Synthetic polypeptide
  XENP022961 [ICOS]_H0.61_L0.37_Fab-1G6_L1.194_H1.279 scFv-Fc Heavy Chain

SEQ ID NO: 28449 - protein, 214 aa, Artificial Sequence; identical to SEQ ID NO: 26537
  Description of Artificial Sequence: Synthetic polypeptide
  XENP022961 [ICOS]_H0.61_L0.37_Fab-1G6_L1.194_H1.279 Light Chain

SEQ ID NO: 28450 - protein, 454 aa, Artificial Sequence; identical to SEQ ID NO: 28201
  Description of Artificial Sequence: Synthetic polypeptide
  XENP023090 [ICOS]_H0.37_L0_Fab-1G6_L1.194_H1.279 Fab-Fc Heavy Chain

SEQ ID NO: 28451 - protein, 480 aa, Artificial Sequence; identical to SEQ ID NO: 2870
  Description of Artificial Sequence: Synthetic polypeptide
  XENP023090 [ICOS]_H0.37_L0_Fab-1G6_L1.194_H1.279 scFv-Fc Heavy Chain

SEQ ID NO: 28452 - protein, 214 aa, Artificial Sequence; identical to SEQ ID NO: 26297
  Description of Artificial Sequence: Synthetic polypeptide
  XENP023090 [ICOS]_H0.37_L0_Fab-1G6_L1.194_H1.279 Light Chain

SEQ ID NO: 28453 - protein, 454 aa, Artificial Sequence; identical to SEQ ID NO: 28261
  Description of Artificial Sequence: Synthetic polypeptide
  XENP023091 [ICOS]_H0.64_L0_Fab-1G6_L1.194_H1.279 Fab-Fc Heavy Chain

SEQ ID NO: 28454 - protein, 480 aa, Artificial Sequence; identical to SEQ ID NO: 2870
  Description of Artificial Sequence: Synthetic polypeptide
  XENP023091 [ICOS]_H0.64_L0_Fab-1G6_L1.194_H1.279 scFv-Fc Heavy Chain

SEQ ID NO: 28455 - protein, 214 aa, Artificial Sequence; identical to SEQ ID NO: 26297
  Description of Artificial Sequence: Synthetic polypeptide
  XENP023091 [ICOS]_H0.64_L0_Fab-1G6_L1.194_H1.279 Light Chain

SEQ ID NO: 28456 - protein, 454 aa, Artificial Sequence; identical to SEQ ID NO: 26562
  Description of Artificial Sequence: Synthetic polypeptide
  XENP023092 [ICOS]_H0.66_L0_Fab-1G6_L1.194_H1.279 Fab-Fc Heavy Chain

SEQ ID NO: 28457 - protein, 480 aa, Artificial Sequence; identical to SEQ ID NO: 2870
  Description of Artificial Sequence: Synthetic polypeptide
  XENP023092 [ICOS]_H0.66_L0_Fab-1G6_L1.194_H1.279 scFv-Fc Heavy Chain

SEQ ID NO: 28458 - protein, 214 aa, Artificial Sequence; identical to SEQ ID NO: 26297
  Description of Artificial Sequence: Synthetic polypeptide
  XENP023092 [ICOS]_H0.66_L0_Fab-1G6_L1.194_H1.279 Light Chain

SEQ ID NO: 28459 - protein, 454 aa, Artificial Sequence; identical to SEQ ID NO: 28267
  Description of Artificial Sequence: Synthetic polypeptide
  XENP023093 [ICOS]_H0.67_L0_Fab-1G6_L1.194_H1.279 Fab-Fc Heavy Chain

SEQ ID NO: 28460 - protein, 480 aa, Artificial Sequence; identical to SEQ ID NO: 2870
  Description of Artificial Sequence: Synthetic polypeptide
  XENP023093 [ICOS]_H0.67_L0_Fab-1G6_L1.194_H1.279 scFv-Fc Heavy Chain

SEQ ID NO: 28461 - protein, 214 aa, Artificial Sequence; identical to SEQ ID NO: 26297
  Description of Artificial Sequence: Synthetic polypeptide
  XENP023093 [ICOS]_H0.67_L0_Fab-1G6_L1.194_H1.279 Light Chain

SEQ ID NO: 28462 - protein, 454 aa, Artificial Sequence; identical to SEQ ID NO: 26562
  Description of Artificial Sequence: Synthetic polypeptide
  XENP023410 [ICOS]_H0.66_L0.34_Fab-1G6_L1.194_H1.279 Fab-Fc Heavy Chain

SEQ ID NO: 28463 - protein, 480 aa, Artificial Sequence; identical to SEQ ID NO: 2870
  Description of Artificial Sequence: Synthetic polypeptide
  XENP023410 [ICOS]_H0.66_L0.34_Fab-1G6_L1.194_H1.279 scFv-Fc Heavy Chain

SEQ ID NO: 28464 - protein, 214 aa, Artificial Sequence; identical to SEQ ID NO: 26497
  Description of Artificial Sequence: Synthetic polypeptide
  XENP023410 [ICOS]_H0.66_L0.34_Fab-1G6_L1.194_H1.279 Light Chain

SEQ ID NO: 28465 - protein, 454 aa, Artificial Sequence; identical to SEQ ID NO: 26362
  Description of Artificial Sequence: Synthetic polypeptide
  XENP022730 [ICOS]_H0L0 _Fab-1G6_L1.194_H1.279 Fab-Fc Heavy Chain

SEQ ID NO: 28466 - protein, 480 aa, Artificial Sequence; identical to SEQ ID NO: 2930
  Description of Artificial Sequence: Synthetic polypeptide
  XENP022730 [ICOS]_H0L0 _Fab-1G6_L1.194_H1.279 scFv-Fc Heavy Chain

SEQ ID NO: 28467 - protein, 214 aa, Artificial Sequence; identical to SEQ ID NO: 26297
  Description of Artificial Sequence: Synthetic polypeptide
  XENP022730 [ICOS]_H0L0_Fab-1G6_L1.194_H1.279 Light Chain

SEQ ID NO: 28468 - protein, 454 aa, Artificial Sequence; identical to SEQ ID NO: 26362
  Description of Artificial Sequence: Synthetic polypeptide
  XENP022917 [ICOS]_H0_L0.38_Fab-1G6_L1.194_H1.279 Fab-Fc Heavy Chain

SEQ ID NO: 28469 - protein, 480 aa, Artificial Sequence; identical to SEQ ID NO: 2930
  Description of Artificial Sequence: Synthetic polypeptide
  XENP022917 [ICOS]_H0_L0.38_Fab-1G6_L1.194_H1.279 scFv-Fc Heavy Chain

SEQ ID NO: 28470 - protein, 214 aa, Artificial Sequence; identical to SEQ ID NO: 26557
  Description of Artificial Sequence: Synthetic polypeptide
  XENP022917 [ICOS]_H0_L0.38_Fab-1G6_L1.194_H1.279 Light Chain

SEQ ID NO: 28471 - protein, 454 aa, Artificial Sequence; identical to SEQ ID NO: 26362
  Description of Artificial Sequence: Synthetic polypeptide
  XENP022918 [ICOS]_H0_L0.42_Fab-1G6_L1.194_H1.279 Fab-Fc Heavy Chain

SEQ ID NO: 28472 - protein, 480 aa, Artificial Sequence; identical to SEQ ID NO: 2930
  Description of Artificial Sequence: Synthetic polypeptide
  XENP022918 [ICOS]_H0_L0.42_Fab-1G6_L1.194_H1.279 scFv-Fc Heavy Chain

SEQ ID NO: 28473 - protein, 214 aa, Artificial Sequence; identical to SEQ ID NO: 28016
  Description of Artificial Sequence: Synthetic polypeptide
  XENP022918 [ICOS]_H0_L0.42_Fab-1G6_L1.194_H1.279 Light Chain

SEQ ID NO: 28474 - protein, 454 aa, Artificial Sequence; identical to SEQ ID NO: 26362
  Description of Artificial Sequence: Synthetic polypeptide
  XENP022919 [ICOS]_H0_L0.43_Fab-1G6_L1.194_H1.279 Fab-Fc Heavy Chain

SEQ ID NO: 28475 - protein, 480 aa, Artificial Sequence; identical to SEQ ID NO: 2930
  Description of Artificial Sequence: Synthetic polypeptide
  XENP022919 [ICOS]_H0_L0.43_Fab-1G6_L1.194_H1.279 scFv-Fc Heavy Chain

SEQ ID NO: 28476 - protein, 214 aa, Artificial Sequence; identical to SEQ ID NO: 28018
  Description of Artificial Sequence: Synthetic polypeptide
  XENP022919 [ICOS]_H0_L0.43_Fab-1G6_L1.194_H1.279 Light Chain

SEQ ID NO: 28477 - protein, 454 aa, Artificial Sequence; identical to SEQ ID NO: 26362
  Description of Artificial Sequence: Synthetic polypeptide
  XENP022920 [ICOS]_H0_L0.44_Fab-1G6_L1.194_H1.279 Fab-Fc Heavy Chain

SEQ ID NO: 28478 - protein, 480 aa, Artificial Sequence; identical to SEQ ID NO: 2930
  Description of Artificial Sequence: Synthetic polypeptide
  XENP022920 [ICOS]_H0_L0.44_Fab-1G6_L1.194_H1.279 scFv-Fc Heavy Chain

SEQ ID NO: 28479 - protein, 214 aa, Artificial Sequence; identical to SEQ ID NO: 28020
  Description of Artificial Sequence: Synthetic polypeptide
  XENP022920 [ICOS]_H0_L0.44_Fab-1G6_L1.194_H1.279 Light Chain

SEQ ID NO: 28480 - protein, 454 aa, Artificial Sequence; identical to SEQ ID NO: 28408
  Description of Artificial Sequence: Synthetic polypeptide
  XENP022921 [ICOS]_H0.35_L0.38_Fab-1G6_L1.194_H1.279 Fab-Fc Heavy Chain

SEQ ID NO: 28481 - protein, 480 aa, Artificial Sequence; identical to SEQ ID NO: 2930
  Description of Artificial Sequence: Synthetic polypeptide
  XENP022921 [ICOS]_H0.35_L0.38_Fab-1G6_L1.194_H1.279 scFv-Fc Heavy Chain

SEQ ID NO: 28482 - protein, 214 aa, Artificial Sequence; identical to SEQ ID NO: 26557
  Description of Artificial Sequence: Synthetic polypeptide
  XENP022921 [ICOS]_H0.35_L0.38_Fab-1G6_L1.194_H1.279 Light Chain

SEQ ID NO: 28483 - protein, 454 aa, Artificial Sequence; identical to SEQ ID NO: 28408
  Description of Artificial Sequence: Synthetic polypeptide
  XENP022922 [ICOS]_H0.35_L0.42_Fab-1G6_L1.194_H1.279 Fab-Fc Heavy Chain

SEQ ID NO: 28484 - protein, 480 aa, Artificial Sequence; identical to SEQ ID NO: 2930
  Description of Artificial Sequence: Synthetic polypeptide
  XENP022922 [ICOS]_H0.35_L0.42_Fab-1G6_L1.194_H1.279 scFv-Fc Heavy Chain

SEQ ID NO: 28485 - protein, 214 aa, Artificial Sequence; identical to SEQ ID NO: 28016
  Description of Artificial Sequence: Synthetic polypeptide
  XENP022922 [ICOS]_H0.35_L0.42_Fab-1G6_L1.194_H1.279 Light Chain

SEQ ID NO: 28486 - protein, 454 aa, Artificial Sequence; identical to SEQ ID NO: 28408
  Description of Artificial Sequence: Synthetic polypeptide
  XENP022923 [ICOS]_H0.35_L0.43_Fab-1G6_L1.194_H1.279 Fab-Fc Heavy Chain

SEQ ID NO: 28487 - protein, 480 aa, Artificial Sequence; identical to SEQ ID NO: 2930
  Description of Artificial Sequence: Synthetic polypeptide
  XENP022923 [ICOS]_H0.35_L0.43_Fab-1G6_L1.194_H1.279 scFv-Fc Heavy Chain

SEQ ID NO: 28488 - protein, 214 aa, Artificial Sequence; identical to SEQ ID NO: 28018
  Description of Artificial Sequence: Synthetic polypeptide
  XENP022923 [ICOS]_H0.35_L0.43_Fab-1G6_L1.194_H1.279 Light Chain

SEQ ID NO: 28489 - protein, 454 aa, Artificial Sequence; identical to SEQ ID NO: 28408
  Description of Artificial Sequence: Synthetic polypeptide
  XENP022924 [ICOS]_H0.35_L0.44_Fab-1G6_L1.194_H1.279 Fab-Fc Heavy Chain

SEQ ID NO: 28490 - protein, 480 aa, Artificial Sequence; identical to SEQ ID NO: 2930
  Description of Artificial Sequence: Synthetic polypeptide
  XENP022924 [ICOS]_H0.35_L0.44_Fab-1G6_L1.194_H1.279 scFv-Fc Heavy Chain

SEQ ID NO: 28491 - protein, 214 aa, Artificial Sequence; identical to SEQ ID NO: 28020
  Description of Artificial Sequence: Synthetic polypeptide
  XENP022924 [ICOS]_H0.35_L0.44_Fab-1G6_L1.194_H1.279 Light Chain

SEQ ID NO: 28492 - protein, 454 aa, Artificial Sequence; identical to SEQ ID NO: 28411
  Description of Artificial Sequence: Synthetic polypeptide
  XENP022925 [ICOS]_H0.61_L0.38_Fab-1G6_L1.194_H1.279 Fab-Fc Heavy Chain

SEQ ID NO: 28493 - protein, 480 aa, Artificial Sequence; identical to SEQ ID NO: 2930
  Description of Artificial Sequence: Synthetic polypeptide
  XENP022925 [ICOS]_H0.61_L0.38_Fab-1G6_L1.194_H1.279 scFv-Fc Heavy Chain

SEQ ID NO: 28494 - protein, 214 aa, Artificial Sequence; identical to SEQ ID NO: 26557
  Description of Artificial Sequence: Synthetic polypeptide
  XENP022925 [ICOS]_H0.61_L0.38_Fab-1G6_L1.194_H1.279 Light Chain

SEQ ID NO: 28495 - protein, 454 aa, Artificial Sequence; identical to SEQ ID NO: 28411
  Description of Artificial Sequence: Synthetic polypeptide
  XENP022926 [ICOS]_H0.61_L0.42_Fab-1G6_L1.194_H1.279 Fab-Fc Heavy Chain

SEQ ID NO: 28496 - protein, 480 aa, Artificial Sequence; identical to SEQ ID NO: 2930
  Description of Artificial Sequence: Synthetic polypeptide
  XENP022926 [ICOS]_H0.61_L0.42_Fab-1G6_L1.194_H1.279 scFv-Fc Heavy Chain

SEQ ID NO: 28497 - protein, 214 aa, Artificial Sequence; identical to SEQ ID NO: 28016
  Description of Artificial Sequence: Synthetic polypeptide
  XENP022926 [ICOS]_H0.61_L0.42_Fab-1G6_L1.194_H1.279 Light Chain

SEQ ID NO: 28498 - protein, 454 aa, Artificial Sequence; identical to SEQ ID NO: 28411
  Description of Artificial Sequence: Synthetic polypeptide
  XENP022927 [ICOS]_H0.61_L0.43_Fab-1G6_L1.194_H1.279 Fab-Fc Heavy Chain

SEQ ID NO: 28499 - protein, 480 aa, Artificial Sequence; identical to SEQ ID NO: 2930
  Description of Artificial Sequence: Synthetic polypeptide
  XENP022927 [ICOS]_H0.61_L0.43_Fab-1G6_L1.194_H1.279 scFv-Fc Heavy Chain

SEQ ID NO: 28500 - protein, 214 aa, Artificial Sequence; identical to SEQ ID NO: 28018
  Description of Artificial Sequence: Synthetic polypeptide
  XENP022927 [ICOS]_H0.61_L0.43_Fab-1G6_L1.194_H1.279 Light Chain

SEQ ID NO: 28501 - protein, 454 aa, Artificial Sequence; identical to SEQ ID NO: 28411
  Description of Artificial Sequence: Synthetic polypeptide
  XENP022928 [ICOS]_H0.61_L0.44_Fab-1G6_L1.194_H1.279 Fab-Fc Heavy Chain

SEQ ID NO: 28502 - protein, 480 aa, Artificial Sequence; identical to SEQ ID NO: 2930
  Description of Artificial Sequence: Synthetic polypeptide
  XENP022928 [ICOS]_H0.61_L0.44_Fab-1G6_L1.194_H1.279 scFv-Fc Heavy Chain

SEQ ID NO: 28503 - protein, 214 aa, Artificial Sequence; identical to SEQ ID NO: 28020
  Description of Artificial Sequence: Synthetic polypeptide
  XENP022928 [ICOS]_H0.61_L0.44_Fab-1G6_L1.194_H1.279 Light Chain

SEQ ID NO: 28504 - protein, 454 aa, Artificial Sequence; identical to SEQ ID NO: 26362
  Description of Artificial Sequence: Synthetic polypeptide
  XENP022935 [ICOS]_H0_L0.36_Fab-1G6_L1.194_H1.279 Fab-Fc Heavy Chain

SEQ ID NO: 28505 - protein, 480 aa, Artificial Sequence; identical to SEQ ID NO: 2930
  Description of Artificial Sequence: Synthetic polypeptide
  XENP022935 [ICOS]_H0_L0.36_Fab-1G6_L1.194_H1.279 scFv-Fc Heavy Chain

SEQ ID NO: 28506 - protein, 214 aa, Artificial Sequence; identical to SEQ ID NO: 26517
  Description of Artificial Sequence: Synthetic polypeptide
  XENP022935 [ICOS]_H0_L0.36_Fab-1G6_L1.194_H1.279 Light Chain

SEQ ID NO: 28507 - protein, 454 aa, Artificial Sequence; identical to SEQ ID NO: 28408
  Description of Artificial Sequence: Synthetic polypeptide
  XENP022936 [ICOS]_H0.35_L0.36_Fab-1G6_L1.194_H1.279 Fab-Fc Heavy Chain

SEQ ID NO: 28508 - protein, 480 aa, Artificial Sequence; identical to SEQ ID NO: 2930
  Description of Artificial Sequence: Synthetic polypeptide
  XENP022936 [ICOS]_H0.35_L0.36_Fab-1G6_L1.194_H1.279 scFv-Fc Heavy Chain

SEQ ID NO: 28509 - protein, 214 aa, Artificial Sequence; identical to SEQ ID NO: 26517
  Description of Artificial Sequence: Synthetic polypeptide
  XENP022936 [ICOS]_H0.35_L0.36_Fab-1G6_L1.194_H1.279 Light Chain

SEQ ID NO: 28510 - protein, 454 aa, Artificial Sequence; identical to SEQ ID NO: 28411
  Description of Artificial Sequence: Synthetic polypeptide
  XENP022937 [ICOS]_H0.61_L0.36_Fab-1G6_L1.194_H1.279 Fab-Fc Heavy Chain

SEQ ID NO: 28511 - protein, 480 aa, Artificial Sequence; identical to SEQ ID NO: 2930
  Description of Artificial Sequence: Synthetic polypeptide
  XENP022937 [ICOS]_H0.61_L0.36_Fab-1G6_L1.194_H1.279 scFv-Fc Heavy Chain

SEQ ID NO: 28512 - protein, 214 aa, Artificial Sequence; identical to SEQ ID NO: 26517
  Description of Artificial Sequence: Synthetic polypeptide
  XENP022937 [ICOS]_H0.61_L0.36_Fab-1G6_L1.194_H1.279 Light Chain

SEQ ID NO: 28513 - protein, 454 aa, Artificial Sequence; identical to SEQ ID NO: 26362
  Description of Artificial Sequence: Synthetic polypeptide
  XENP022974 [ICOS]_H0_L0.34_Fab-1G6_L1.194_H1.279 Fab-Fc Heavy Chain

SEQ ID NO: 28514 - protein, 480 aa, Artificial Sequence; identical to SEQ ID NO: 2930
  Description of Artificial Sequence: Synthetic polypeptide
  XENP022974 [ICOS]_H0_L0.34_Fab-1G6_L1.194_H1.279 scFv-Fc Heavy Chain

SEQ ID NO: 28515 - protein, 214 aa, Artificial Sequence; identical to SEQ ID NO: 26497
  Description of Artificial Sequence: Synthetic polypeptide
  XENP022974 [ICOS]_H0_L0.34_Fab-1G6_L1.194_H1.279 Light Chain

SEQ ID NO: 28516 - protein, 454 aa, Artificial Sequence; identical to SEQ ID NO: 28408
  Description of Artificial Sequence: Synthetic polypeptide
  XENP022975 [ICOS]_H0.35_L0.34_Fab-1G6_L1.194_H1.279 Fab-Fc Heavy Chain

SEQ ID NO: 28517 - protein, 480 aa, Artificial Sequence; identical to SEQ ID NO: 2930
  Description of Artificial Sequence: Synthetic polypeptide
  XENP022975 [ICOS]_H0.35_L0.34_Fab-1G6_L1.194_H1.279 scFv-Fc Heavy Chain

SEQ ID NO: 28518 - protein, 214 aa, Artificial Sequence; identical to SEQ ID NO: 26497
  Description of Artificial Sequence: Synthetic polypeptide
  XENP022975 [ICOS]_H0.35_L0.34_Fab-1G6_L1.194_H1.279 Light Chain

SEQ ID NO: 28519 - protein, 454 aa, Artificial Sequence; identical to SEQ ID NO: 28411
  Description of Artificial Sequence: Synthetic polypeptide
  XENP022976 [ICOS]_H0.61_L0.34_Fab-1G6_L1.194_H1.279 Fab-Fc Heavy Chain

SEQ ID NO: 28520 - protein, 480 aa, Artificial Sequence; identical to SEQ ID NO: 2930
  Description of Artificial Sequence: Synthetic polypeptide
  XENP022976 [ICOS]_H0.61_L0.34_Fab-1G6_L1.194_H1.279 scFv-Fc Heavy Chain

SEQ ID NO: 28521 - protein, 214 aa, Artificial Sequence; identical to SEQ ID NO: 26497
  Description of Artificial Sequence: Synthetic polypeptide
  XENP022976 [ICOS]_H0.61_L0.34_Fab-1G6_L1.194_H1.279 Light Chain

SEQ ID NO: 28522 - protein, 454 aa, Artificial Sequence; identical to SEQ ID NO: 26362
  Description of Artificial Sequence: Synthetic polypeptide
  XENP022977 [ICOS]_H0_L0.37_Fab-1G6_L1.194_H1.279 Fab-Fc Heavy Chain

SEQ ID NO: 28523 - protein, 480 aa, Artificial Sequence; identical to SEQ ID NO: 2930
  Description of Artificial Sequence: Synthetic polypeptide
  XENP022977 [ICOS]_H0_L0.37_Fab-1G6_L1.194_H1.279 scFv-Fc Heavy Chain

SEQ ID NO: 28524 - protein, 214 aa, Artificial Sequence; identical to SEQ ID NO: 26537
  Description of Artificial Sequence: Synthetic polypeptide
  XENP022977 [ICOS]_H0_L0.37_Fab-1G6_L1.194_H1.279 Light Chain

SEQ ID NO: 28525 - protein, 454 aa, Artificial Sequence; identical to SEQ ID NO: 28408
  Description of Artificial Sequence: Synthetic polypeptide
  XENP022978 [ICOS]_H0.35_L0.37_Fab-1G6_L1.194_H1.279 Fab-Fc Heavy Chain

SEQ ID NO: 28526 - protein, 480 aa, Artificial Sequence; identical to SEQ ID NO: 2930
  Description of Artificial Sequence: Synthetic polypeptide
  XENP022978 [ICOS]_H0.35_L0.37_Fab-1G6_L1.194_H1.279 scFv-Fc Heavy Chain

SEQ ID NO: 28527 - protein, 214 aa, Artificial Sequence; identical to SEQ ID NO: 26537
  Description of Artificial Sequence: Synthetic polypeptide
  XENP022978 [ICOS]_H0.35_L0.37_Fab-1G6_L1.194_H1.279 Light Chain

SEQ ID NO: 28528 - protein, 454 aa, Artificial Sequence; identical to SEQ ID NO: 28411
  Description of Artificial Sequence: Synthetic polypeptide
  XENP022979 [ICOS]_H0.61_L0.37_Fab-1G6_L1.194_H1.279 Fab-Fc Heavy Chain

SEQ ID NO: 28529 - protein, 480 aa, Artificial Sequence; identical to SEQ ID NO: 2930
  Description of Artificial Sequence: Synthetic polypeptide
  XENP022979 [ICOS]_H0.61_L0.37_Fab-1G6_L1.194_H1.279 scFv-Fc Heavy Chain

SEQ ID NO: 28530 - protein, 214 aa, Artificial Sequence; identical to SEQ ID NO: 26537
  Description of Artificial Sequence: Synthetic polypeptide
  XENP022979 [ICOS]_H0.61_L0.37_Fab-1G6_L1.194_H1.279 Light Chain

SEQ ID NO: 28531 - protein, 454 aa, Artificial Sequence; identical to SEQ ID NO: 26362
  Description of Artificial Sequence: Synthetic polypeptide
  XENP022995 [ICOS]_H0_L0.35_Fab-1G6_L1.194_H1.279 Fab-Fc Heavy Chain

SEQ ID NO: 28532 - protein, 480 aa, Artificial Sequence; identical to SEQ ID NO: 2930
  Description of Artificial Sequence: Synthetic polypeptide
  XENP022995 [ICOS]_H0_L0.35_Fab-1G6_L1.194_H1.279 scFv-Fc Heavy Chain

SEQ ID NO: 28533 - protein, 214 aa, Artificial Sequence; identical to SEQ ID NO: 28008
  Description of Artificial Sequence: Synthetic polypeptide
  XENP022995 [ICOS]_H0_L0.35_Fab-1G6_L1.194_H1.279 Light Chain

SEQ ID NO: 28534 - protein, 454 aa, Artificial Sequence; identical to SEQ ID NO: 28408
  Description of Artificial Sequence: Synthetic polypeptide
  XENP022996 [ICOS]_H0.35_L0.35_Fab-1G6_L1.194_H1.279 Fab-Fc Heavy Chain

SEQ ID NO: 28535 - protein, 480 aa, Artificial Sequence; identical to SEQ ID NO: 2930
  Description of Artificial Sequence: Synthetic polypeptide
  XENP022996 [ICOS]_H0.35_L0.35_Fab-1G6_L1.194_H1.279 scFv-Fc Heavy Chain

SEQ ID NO: 28536 - protein, 214 aa, Artificial Sequence; identical to SEQ ID NO: 28008
  Description of Artificial Sequence: Synthetic polypeptide
  XENP022996 [ICOS]_H0.35_L0.35_Fab-1G6_L1.194_H1.279 Light Chain

SEQ ID NO: 28537 - protein, 454 aa, Artificial Sequence; identical to SEQ ID NO: 28411
  Description of Artificial Sequence: Synthetic polypeptide
  XENP023001 [ICOS]_H0.61_L0.35_Fab-1G6_L1.194_H1.279 Fab-Fc Heavy Chain

SEQ ID NO: 28538 - protein, 480 aa, Artificial Sequence; identical to SEQ ID NO: 2930
  Description of Artificial Sequence: Synthetic polypeptide
  XENP023001 [ICOS]_H0.61_L0.35_Fab-1G6_L1.194_H1.279 scFv-Fc Heavy Chain

SEQ ID NO: 28539 - protein, 214 aa, Artificial Sequence; identical to SEQ ID NO: 28008
  Description of Artificial Sequence: Synthetic polypeptide
  XENP023001 [ICOS]_H0.61_L0.35_Fab-1G6_L1.194_H1.279 Light Chain

SEQ ID NO: 28540 - protein, 454 aa, Artificial Sequence
  Description of Artificial Sequence: Synthetic polypeptide
  XENP023103 [ICOS]_H0.37_L0_Fab-1G6_L1.194_H1.279 Fab-Fc Heavy Chain
QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 28541 - protein, 480 aa, Artificial Sequence; identical to SEQ ID NO: 2930
  Description of Artificial Sequence: Synthetic polypeptide
  XENP023103 [ICOS]_H0.37_L0_Fab-1G6_L1.194_H1.279 scFv-Fc Heavy Chain

SEQ ID NO: 28542 - protein, 214 aa, Artificial Sequence; identical to SEQ ID NO: 26297
  Description of Artificial Sequence: Synthetic polypeptide
  XENP023103 [ICOS]_H0.37_L0_Fab-1G6_L1.194_H1.279 Light Chain

SEQ ID NO: 28543 - protein, 454 aa, Artificial Sequence; identical to SEQ ID NO: 26642
  Description of Artificial Sequence: Synthetic polypeptide
  XENP023104 [ICOS]_H0.66_L0_Fab-1G6_L1.194_H1.279 Fab-Fc Heavy Chain

SEQ ID NO: 28544 - protein, 480 aa, Artificial Sequence; identical to SEQ ID NO: 2930
  Description of Artificial Sequence: Synthetic polypeptide
  XENP023104 [ICOS]_H0.66_L0_Fab-1G6_L1.194_H1.279 scFv-Fc Heavy Chain

SEQ ID NO: 28545 - protein, 214 aa, Artificial Sequence; identical to SEQ ID NO: 26297
  Description of Artificial Sequence: Synthetic polypeptide
  XENP023104 [ICOS]_H0.66_L0_Fab-1G6_L1.194_H1.279 Light Chain

SEQ ID NO: 28546 - protein, 454 aa, Artificial Sequence; identical to SEQ ID NO: 26642
  Description of Artificial Sequence: Synthetic polypeptide
  XENP023411 [ICOS]_H0.66_L0.34_Fab-1G6_L1.194_H1.279 Fab-Fc Heavy Chain

SEQ ID NO: 28547 - protein, 480 aa, Artificial Sequence; identical to SEQ ID NO: 2930
  Description of Artificial Sequence: Synthetic polypeptide
  XENP023411 [ICOS]_H0.66_L0.34_Fab-1G6_L1.194_H1.279 scFv-Fc Heavy Chain

SEQ ID NO: 28548 - protein, 214 aa, Artificial Sequence; identical to SEQ ID NO: 26497
  Description of Artificial Sequence: Synthetic polypeptide
  XENP023411 [ICOS]_H0.66_L0.34_Fab-1G6_L1.194_H1.279 Light Chain

SEQ ID NO: 28549 - protein, 449 aa, Artificial Sequence
  Description of Artificial Sequence: Synthetic polypeptide
  XENP015074 Numax FcKO mAb Heavy Chain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28550 - protein, 213 aa, Artificial Sequence
  Description of Artificial Sequence: Synthetic polypeptide
  XENP015074 Numax FcKO mAb Light Chain
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28551 - protein, 442 aa, Artificial Sequence; identical to SEQ ID NO: 16161
  Description of Artificial Sequence: Synthetic polypeptide
  XENP016432 nivolumab_H0L0 FcKO mAb Heavy Chain

SEQ ID NO: 28552 - protein, 214 aa, Artificial Sequence; identical to SEQ ID NO: 16146
  Description of Artificial Sequence: Synthetic polypeptide
  XENP016432 nivolumab_H0L0 FcKO mAb Light Chain

SEQ ID NO: 28553 - protein, 454 aa, Artificial Sequence; identical to SEQ ID NO: 26292
  Description of Artificial Sequence: Synthetic polypeptide
  XENP016435 [ICOS]_H0L0 FcKO mAb Heavy Chain

SEQ ID NO: 28554 - protein, 214 aa, Artificial Sequence; identical to SEQ ID NO: 26297
  Description of Artificial Sequence: Synthetic polypeptide
  XENP016435 [ICOS]_H0L0 FcKO mAb Light Chain

SEQ ID NO: 28555 - protein, 231 aa, Artificial Sequence; identical to SEQ ID NO: 2393
  Description of Artificial Sequence: Synthetic polypeptide
  XENP020111 1G6_L1.194_H1.279 one-arm mAb Fc-only Heavy Chain

SEQ ID NO: 28556 - protein, 480 aa, Artificial Sequence; identical to SEQ ID NO: 2870
  Description of Artificial Sequence: Synthetic polypeptide
  XENP020111 1G6_L1.194_H1.279 one-arm mAb scFv-Fc Heavy Chain

SEQ ID NO: 28557 - protein, 252 aa, Artificial Sequence
  Description of Artificial Sequence: Synthetic polypeptide
  XENPA1 (XENP022050 [ICOS]_H0L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28558 - protein, 252 aa, Artificial Sequence
  Description of Artificial Sequence: Synthetic polypeptide
  XENPA2 (XENP022051 [ICOS]_H0.1_L0 scFv)
QVQLVQSGAEVKKPGASVKVSCKASGYTFTEYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28559 - protein, 252 aa, Artificial Sequence
  Description of Artificial Sequence: Synthetic polypeptide
  XENPA3 (XENP022052 [ICOS]_H0.2_L0 scFv)
QVQLVQSGAEVKKPGASVKVSCKASGYTFTSYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28560 - protein, 252 aa, Artificial Sequence
  Description of Artificial Sequence: Synthetic polypeptide
  XENPA4 (XENP022053 [ICOS]_H0.3_L0 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28561 - protein, 252 aa, Artificial Sequence
  Description of Artificial Sequence: Synthetic polypeptide
  XENPA5 (XENP022054 [ICOS]_H0.4_L0 scFv)
QVQLVQSGAEVKKPGASVKVSCKASGYTFTGYYMHWVRQAPGQGLEWMGWINPESGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28562 - protein, 252 aa, Artificial Sequence
  Description of Artificial Sequence: Synthetic polypeptide
  XENPA6 (XENP022055 [ICOS]_H0.5_L0 scFv)
QVQLVQSGAEVKKPGASVKVSCKASGYTFTGYYMHWVRQAPGQGLEWMGWINPSSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28563 - protein, 252 aa, Artificial Sequence
  Description of Artificial Sequence: Synthetic polypeptide
  XENPA7 (XENP022056 [ICOS]_H0.6_L0 scFv)
QVQLVQSGAEVKKPGASVKVSCKASGYTFTGYYMHWVRQAPGQGLEWMGWINPHGGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28564 - protein, 252 aa, Artificial Sequence
  Description of Artificial Sequence: Synthetic polypeptide
  XENPA8 (XENP022057 [ICOS]_H0.7_L0 scFv)
QVQLVQSGAEVKKPGASVKVSCKASGYTFTGYYMHWVRQAPGQGLEWMGWINPHSGETNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28565 - protein, 252 aa, Artificial Sequence
  Description of Artificial Sequence: Synthetic polypeptide
  XENPA9 (XENP022058 [ICOS]_H0.8_L0 scFv)
QVQLVQSGAEVKKPGASVKVSCKASGYTFTGYYMHWVRQAPGQGLEWMGWINPHSGGTSYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28566 - protein, 251 aa, Artificial Sequence
  Description of Artificial Sequence: Synthetic polypeptide
  XENPA10 (XENP022059 [ICOS]_H0.9_L0 scFv)
QVQLVQSGAEVKKPGASVKVSCKASGYTFTGYYMHWVRQAPGQGLEWMGWINPHSGGTNYAEKFQGRVTMTRDTSISTAYMELSRLRSDDTAVYYCARTYYYDSSGYYHDAFDIWGQGTMVTVSSGKPGSGKPGSGKPGSGKPGSIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28567 - protein, 252 aa, Artificial Sequence
  Description of Artificial Sequence: Synthetic polypeptide
  XENPA11 (XENP022060 [ICOS]_H0.10_L0 scFv)
QVQLVQSGAEVKKPGASVKVSCKASGYTFTGYYMHWVRQAPGQGLEWMGWINPHSGGTNYAQKFQERVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28568 - protein, 252 aa, Artificial Sequence
  Description of Artificial Sequence: Synthetic polypeptide
  XENPA12 (XENP022061 [ICOS]_H0.11_L0 scFv)
QVQLVQSGAEVKKPGASVKVSCKASGYTFTGYYMHWVRQAPGQGLEWMGWINPHSGGTNYAQKFQGRVTITRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28569 - protein, 252 aa, Artificial Sequence
  Description of Artificial Sequence: Synthetic polypeptide
  XENPA13 (XENP022062 [ICOS]_H0.12_L0 scFv)
QVQLVQSGAEVKKPGASVKVSCKASGYTFTGYYMHWVRQAPGQGLEWMGWINPHSGGTNYAQKFQGRVTMTADTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28570 - protein, 252 aa, Artificial Sequence
  Description of Artificial Sequence: Synthetic polypeptide
  XENPA14 (XENP022063 [ICOS]_H0.13_L0 scFv)
QVQLVQSGAEVKKPGASVKVSCKASGYTFTGYYMHWVRQAPGQGLEWMGWINPHSGGTNYAQKFQGRVTMTEDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28571 - protein, 252 aa, Artificial Sequence
  Description of Artificial Sequence: Synthetic polypeptide
  XENPA15 (XENP022064 [ICOS]_H0.14_L0 scFv)
QVQLVQSGAEVKKPGASVKVSCKASGYTFTGYYMHWVRQAPGQGLEWMGWINPHSGGTNYAQKFQGRVTMTTDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28572 - protein, 252 aa, Artificial Sequence
  Description of Artificial Sequence: Synthetic polypeptide
  XENPA16 (XENP022065 [ICOS]_H0.15_L0 scFv)
QVQLVQSGAEVKKPGASVKVSCKASGYTFTGYYMHWVRQAPGQGLEWMGWINPHSGGTNYAQKFQGRVTMTRDESISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28573 - protein, 252 aa, Artificial Sequence
  Description of Artificial Sequence: Synthetic polypeptide
  XENPA17 (XENP022066 [ICOS]_H0.16_L0 scFv)
QVQLVQSGAEVKKPGASVKVSCKASGYTFTGYYMHWVRQAPGQGLEWMGWINPHSGGTNYAQKFQGRVTMTRDTSTSTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28574 - protein, 252 aa, Artificial Sequence
  Description of Artificial Sequence: Synthetic polypeptide
  XENPA18 (XENP022067 [ICOS]_H0.17_L0 scFv)
QVQLVQSGAEVKKPGASVKVSCKASGYTFTGYYMHWVRQAPGQGLEWMGWINPHSGGTNYAQKFQGRVTMTRDTSISTAYMELSSLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28575 - protein, 252 aa, Artificial Sequence
  Description of Artificial Sequence: Synthetic polypeptide
  XENPA19 (XENP022068 [ICOS]_H0.18_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSEDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28576 - protein, 252 aa, Artificial Sequence
  Description of Artificial Sequence: Synthetic polypeptide
  XENPA20 (XENP022069 [ICOS]_H0.19_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYASSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28577 - protein, 252 aa, Artificial Sequence
  Description of Artificial Sequence: Synthetic polypeptide
  XENPA21 (XENP022070 [ICOS]_H0.20_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYESSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28578 - protein, 252 aa, Artificial Sequence
  Description of Artificial Sequence: Synthetic polypeptide
  XENPA22 (XENP022071 [ICOS]_H0.21_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYQSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28579 - protein, 252 aa, Artificial Sequence
  Description of Artificial Sequence: Synthetic polypeptide
  XENPA23 (XENP022072 [ICOS]_H0.22_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYSSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28580 - protein, 252 aa, Artificial Sequence
  Description of Artificial Sequence: Synthetic polypeptide
  XENPA24 (XENP022073 [ICOS]_H0.23_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYTSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28581 - protein, 252 aa, Artificial Sequence
  Description of Artificial Sequence: Synthetic polypeptide
  XENPA25 (XENP022074 [ICOS]_H0.24_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28582 - protein, 252 aa, Artificial Sequence
  Description of Artificial Sequence: Synthetic polypeptide
  XENPA26 (XENP022075 [ICOS]_H0.25_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYEDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28583 - protein, 252 aa, Artificial Sequence
  Description of Artificial Sequence: Synthetic polypeptide
  XENPA27 (XENP022076 [ICOS]_H0.26_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYQDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28584 - protein, 252 aa, Artificial Sequence
  Description of Artificial Sequence: Synthetic polypeptide
  XENPA28 (XENP022077 [ICOS]_H0.27_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYSDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28585 - protein, 251 aa, Artificial Sequence
  Description of Artificial Sequence: Synthetic polypeptide
  XENPA29 (XENP022078 [ICOS]_H0.28_L0 scFv)
QVQLVQSAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYYDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28586 - protein, 252 aa, Artificial Sequence
  Description of Artificial Sequence: Synthetic polypeptide
  XENPA30 (XENP022079 [ICOS]_H0.29_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHAAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28587 - protein, 252 aa, Artificial Sequence
  Description of Artificial Sequence: Synthetic polypeptide
  XENPA31 (XENP022080 [ICOS]_H0.30_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHEAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28588 - protein, 252 aa, Artificial Sequence
  Description of Artificial Sequence: Synthetic polypeptide
  XENPA32 (XENP022081 [ICOS]_H0.31_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHQAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28589 - protein, 252 aa, Artificial Sequence
  Description of Artificial Sequence: Synthetic polypeptide
  XENPA33 (XENP022082 [ICOS]_H0.32_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHSAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28590 - protein, 252 aa, Artificial Sequence
  Description of Artificial Sequence: Synthetic polypeptide
  XENPA34 (XENP022083 [ICOS]_H0.33_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHTAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28591 - protein, 252 aa, Artificial Sequence
  Description of Artificial Sequence: Synthetic polypeptide
  XENPA35 (XENP022084 [ICOS]_H0.34_L0 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDVWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28592 - protein, 252 aa, Artificial Sequence
  Description of Artificial Sequence: Synthetic polypeptide
  XENPA36 (XENP022085 [ICOS]_H0_L0.1 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSLSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28593 - protein, 252 aa, Artificial Sequence
  Description of Artificial Sequence: Synthetic polypeptide
  XENPA37 (XENP022086 [ICOS]_H0_L0.2 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQGISRLLAWYQQKPGKAPKLLIYVASSLQSGVPSRFSGSGSGTDFTLTISSLQPEDFATYYCQQANSFPWTFGQGTKVEIK

SEQ ID NO: 28594 - protein, 252 aa, Artificial Sequence
  Description of Artificial Sequence: Synthetic polypeptide
  XENPA38 (XENP022087 [ICOS]_H0_L0.3 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISRLLAWYQQKPGKAPKLLIYVASSLQSGVPSRFSGSGSGTDFTLTISSLQPEDFATYYCQQANSFPWTFGQGTKVEIK

SEQ ID NO: 28595 - protein, 252 aa, Artificial Sequence
  Description of Artificial Sequence: Synthetic polypeptide
  XENPA39 (XENP022088 [ICOS]_H0_L0.4 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQSISRLLAWYQQKPGKAPKLLIYVASSLQSGVPSRFSGSGSGTDFTLTISSLQPEDFATYYCQQANSFPWTFGQGTKVEIK

SEQ ID NO: 28596 - protein, 252 aa, Artificial Sequence
  Description of Artificial Sequence: Synthetic polypeptide
  XENPA40 (XENP022089 [ICOS]_H0_L0.5 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISSLLAWYQQKPGKAPKLLIYVASSLQSGVPSRFSGSGSGTDFTLTISSLQPEDFATYYCQQANSFPWTFGQGTKVEIK

SEQ ID NO: 28597 - protein, 464 aa, Artificial Sequence
  Description of Artificial Sequence: Synthetic polypeptide
  XENPA41 (XENP022090 [ICOS]_H0_L0.6 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGSGKPGSGKPGSGKPGSGKPGSDIQMTQSPSSVSASVGDRVTITCRASQGISSWLAWYQQKPGKAPKLLIYVASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28598 - protein, 252 aa, Artificial Sequence
  Description of Artificial Sequence: Synthetic polypeptide
  XENPA42 (XENP022091 [ICOS]_H0_L0.7 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISSYLAWYQQKPGKAPKLLIYVASSLQSGVPSRFSGSGSGTDFTLTISSLQPEDFATYYCQQANSFPWTFGQGTKVEIK

SEQ ID NO: 28599 - protein, 252 aa, Artificial Sequence
  Description of Artificial Sequence: Synthetic polypeptide
  XENPA43 (XENP022092 [ICOS]_H0_L0.8 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRWLAWYQQKPGKAPKLLIYVASSLQSGVPSRFSGSGSGTDFTLTISSLQPEDFATYYCQQANSFPWTFGQGTKVEIK

SEQ ID NO: 28600 - protein, 252 aa, Artificial Sequence
  Description of Artificial Sequence: Synthetic polypeptide
  XENPA44 (XENP022093 [ICOS]_H0_L0.9 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRYLAWYQQKPGKAPKLLIYVASSLQSGVPSRFSGSGSGTDFTLTISSLQPEDFATYYCQQANSFPWTFGQGTKVEIK

SEQ ID NO: 28601 - protein, 252 aa, Artificial Sequence
  Description of Artificial Sequence: Synthetic polypeptide
  XENPA45 (XENP022094 [ICOS]_H0_L0.10 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYAASSLQSGVPSRFSGSGSGTDFTLTISSLQPEDFATYYCQQANSFPWTFGQGTKVEIK

SEQ ID NO: 28602 - protein, 252 aa, Artificial Sequence
  Description of Artificial Sequence: Synthetic polypeptide
  XENPA46 (XENP022095 [ICOS]_H0_L0.11 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYSASSLQSGVPSRFSGSGSGTDFTLTISSLQPEDFATYYCQQANSFPWTFGQGTKVEIK

SEQ ID NO: 28603 - protein, 252 aa, Artificial Sequence
  Description of Artificial Sequence: Synthetic polypeptide
  XENPA47 (XENP022096 [ICOS]_H0_L0.12 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASTLQSGVPSRFSGSGSGTDFTLTISSLQPEDFATYYCQQANSFPWTFGQGTKVEIK

SEQ ID NO: 28604 - protein, 252 aa, Artificial Sequence
  Description of Artificial Sequence: Synthetic polypeptide
  XENPA48 (XENP022101 [ICOS]_H0_L0.13 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLESGVPSRFSGSGSGTDFTLTISSLQPEDFATYYCQQANSFPWTFGQGTKVEIK

SEQ ID NO: 28605 - protein, 252 aa, Artificial Sequence
  Description of Artificial Sequence: Synthetic polypeptide
  XENPA49 (XENP022102 [ICOS]_H0_L0.14 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQSNSFPWTFGQGTKVEIK

SEQ ID NO: 28606 - protein, 252 aa, Artificial Sequence
  Description of Artificial Sequence: Synthetic polypeptide
  XENPA50 (XENP022103 [ICOS]_H0_L0.15 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQAESFPWTFGQGTKVEIK

SEQ ID NO: 28607 - protein, 252 aa, Artificial Sequence
  Description of Artificial Sequence: Synthetic polypeptide
  XENPA51 (XENP022104 [ICOS]_H0_L0.16 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQAQSFPWTFGQGTKVEIK

SEQ ID NO: 28608 - protein, 252 aa, Artificial Sequence
  Description of Artificial Sequence: Synthetic polypeptide
  XENPA52 (XENP022105 [ICOS]_H0_L0.17 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQAYSFPWTFGQGTKVEIK

SEQ ID NO: 28609 - protein, 252 aa, Artificial Sequence
  Description of Artificial Sequence: Synthetic polypeptide
  XENPA53 (XENP022106 [ICOS]_H0_L0.18 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANTFPWTFGQGTKVEIK

SEQ ID NO: 28610 - protein, 252 aa, Artificial Sequence
  Description of Artificial Sequence: Synthetic polypeptide
  XENPA54 (XENP022107 [ICOS]_H0_L0.19 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSTPWTFGQGTKVEIK

SEQ ID NO: 28611 - protein, 252 aa, Artificial Sequence
  Description of Artificial Sequence: Synthetic polypeptide
  XENPA55 (XENP022108 [ICOS]_H0_L0.20 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSYPWTFGQGTKVEIK

SEQ ID NO: 28612 - protein, 252 aa, Artificial Sequence
  Description of Artificial Sequence: Synthetic polypeptide
  XENPA56 (XENP022767 [ICOS]_H0_L0.21 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISSLLAWYQQKPGKAPKLLIYVASSLQSGVPSRFSGSGSGTDFTLTISSLQPEDFATYYCQQANSFPWTFGQGTKVEIK

SEQ ID NO: 28613 - protein, 252 aa, Artificial Sequence
  Description of Artificial Sequence: Synthetic polypeptide
  XENPA57 (XENP022768 [ICOS]_H0_L0.22 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQANSFPWTFGQGTKVEIK

SEQ ID NO: 28614 - protein, 252 aa, Artificial Sequence
  Description of Artificial Sequence: Synthetic polypeptide
  XENPA58 (XENP022769 [ICOS]_H0_L0.23 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISRLLAWYQQKPGKAPKLLIYVASSLQSGVPSRFSGSGSGTDFTLTISSLQPEDFATYYCQQAESFPWTFGQGTKVEIK

SEQ ID NO: 28615 - protein, 252 aa, Artificial Sequence
  Description of Artificial Sequence: Synthetic polypeptide
  XENPA59 (XENP022770 [ICOS]_H0_L0.24 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISSLLAWYQQKPGKAPKLLIYAASSLQSGVPSRFSGSGSGTDFTLTISSLQPEDFATYYCQQANSFPWTFGQGTKVEIK

SEQ ID NO: 28616 - protein, 252 aa, Artificial Sequence
  Description of Artificial Sequence: Synthetic polypeptide
  XENPA60 (XENP022771 [ICOS]_H0_L0.25 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISSLLAWYQQKPGKAPKLLIYVASSLQSGVPSRFSGSGSGTDFTLTISSLQPEDFATYYCQQAESFPWTFGQGTKVEIK

SEQ ID NO: 28617 - protein, 252 aa, Artificial Sequence
  Description of Artificial Sequence: Synthetic polypeptide
  XENPA61 (XENP022772 [ICOS]_H0_L0.26 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYAASSLQSGVPSRFSGSGSGTDFTLTISSLQPEDFATYYCQQAESFPWTFGQGTKVEIK

SEQ ID NO: 28618 - protein, 252 aa, Artificial Sequence
  Description of Artificial Sequence: Synthetic polypeptide
  XENPA62 (XENP022773 [ICOS]_H0_L0.27 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISSLLAWYQQKPGKAPKLLIYAASSLQSGVPSRFSGSGSGTDFTLTISSLQPEDFATYYCQQANSFPWTFGQGTKVEIK

SEQ ID NO: 28619 - protein, 252 aa, Artificial Sequence
  Description of Artificial Sequence: Synthetic polypeptide
  XENPA63 (XENP022774 [ICOS]_H0_L0.28 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISSLLAWYQQKPGKAPKLLIYVASSLQSGVPSRFSGSGSGTDFTLTISSLQPEDFATYYCQQAESFPWTFGQGTKVEIK

SEQ ID NO: 28620 - protein, 359 aa, Artificial Sequence
  Description of Artificial Sequence: Synthetic polypeptide
  XENPA64 (XENP022775 [ICOS]_H0_L0.29 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQAESFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 28621 - protein, 252 aa, Artificial Sequence
  Description of Artificial Sequence: Synthetic polypeptide
  XENPA65 (XENP022776 [ICOS]_H0_L0.30 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISSLLAWYQQKPGKAPKLLIYAASSLQSGVPSRFSGSGSGTDFTLTISSLQPEDFATYYCQQAESFPWTFGQGTKVEIK

SEQ ID NO: 28622 - protein, 252 aa, Artificial Sequence
  Description of Artificial Sequence: Synthetic polypeptide
  XENPA66 (XENP022777 [ICOS]_H0_L0.31 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQDISSLLAWYQQKPGKAPKLLIYAASSLQSGVPSRFSGSGSGTDFTLTISSLQPEDFATYYCQQAESFPWTFGQGTKVEIK

SEQ ID NO: 28623 - protein, 252 aa, Artificial Sequence
  Description of Artificial Sequence: Synthetic polypeptide
  XENPA67 (XENP022778 [ICOS]_H0_L0.32 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSLLAWYQQKPGKAPKLLIYVASSLQSGVPSRFSGSGSGTDFTLTISSLQPEDFATYYCQQANSFPWTFGQGTKVEIK

SEQ ID NO: 28624 - protein, 252 aa, Artificial Sequence
  Description of Artificial Sequence: Synthetic polypeptide
  XENPA68 (XENP022779 [ICOS]_H0_L0.33 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQANSFPWTFGQGTKVEIK

SEQ ID NO: 28625 - protein, 252 aa, Artificial Sequence
  Description of Artificial Sequence: Synthetic polypeptide
  XENPA69 (XENP022780 [ICOS]_H0_L0.34 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIK

SEQ ID NO: 28626 - protein, 252 aa, Artificial Sequence
  Description of Artificial Sequence: Synthetic polypeptide
  XENPA70 (XENP022781 [ICOS]_H0_L0.35 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQANSFPWTFGQGTKVEIK

SEQ ID NO: 28627 - protein, 252 aa, Artificial Sequence
  Description of Artificial Sequence: Synthetic polypeptide
  XENPA71 (XENP022782 [ICOS]_H0_L0.36 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSLLAWYQQKPGKAPKLLIYVASSLQSGVPSRFSGSGSGTDFTLTISSLQPEDFATYYCQQAESFPWTFGQGTKVEIK

SEQ ID NO: 28628 - protein, 252 aa, Artificial Sequence
  Description of Artificial Sequence: Synthetic polypeptide
  XENPA72 (XENP022783 [ICOS]_H0_L0.37 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28629 - protein, 252 aa, Artificial Sequence
  Description of Artificial Sequence: Synthetic polypeptide
  XENPA73 (XENP022784 [ICOS]_H0_L0.38 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28630 - protein, 252 aa, Artificial Sequence
  Description of Artificial Sequence: Synthetic polypeptide
  XENPA74 (XENP022860 [ICOS]_H0_L0.42 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSYLAWYQQKPGKAPKLLIYVASSLQSGVPSRFSGSGSGTDFTLTISSLQPEDFATYYCQQAESFPWTFGQGTKVEIK

SEQ ID NO: 28631 - protein, 252 aa, Artificial Sequence
  Description of Artificial Sequence: Synthetic polypeptide
  XENPA75 (XENP022861 [ICOS]_H0_L0.43 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQAESFPWTFGQGTKVEIK

SEQ ID NO: 28632 - protein, 252 aa, Artificial Sequence
  Description of Artificial Sequence: Synthetic polypeptide
  XENPA76 (XENP022862 [ICOS]_H0_L0.44 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQANSFPWTFGQGTKVEIK

SEQ ID NO: 28633 - protein, 252 aa, Artificial Sequence
  Description of Artificial Sequence: Synthetic polypeptide
  XENPA77 (XENP022863 [ICOS]_H0.35_L0.38 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28634 - protein, 252 aa, Artificial Sequence
  Description of Artificial Sequence: Synthetic polypeptide
  XENPA78 (XENP022864 [ICOS]_H0.35_L0.42 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYVASSLQSGVPSRFSGSGSGTDFTLTISSLQPEDFATYYCQQAESFPWTFGQGTKVEIK

SEQ ID NO: 28635 - protein, 252 aa, Artificial Sequence
  Description of Artificial Sequence: Synthetic polypeptide
  XENPA79 (XENP022865 [ICOS]_H0.35_L0.43 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQAESFPWTFGQGTKVEIK

SEQ ID NO: 28636 - protein, 252 aa, Artificial Sequence
  Description of Artificial Sequence: Synthetic polypeptide
  XENPA80 (XENP022866 [ICOS]_H0.35_L0.44 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQANSFPWTFGQGTKVEIK

SEQ ID NO: 28637 - protein, 252 aa, Artificial Sequence
  Description of Artificial Sequence: Synthetic polypeptide
  XENPA81 (XENP022867 [ICOS]_H0.61_L0.38 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28638 - protein, 252 aa, Artificial Sequence
  Description of Artificial Sequence: Synthetic polypeptide
  XENPA82 (XENP022868 [ICOS]_H0.61_L0.42 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYVASSLQSGVPSRFSGSGSGTDFTLTISSLQPEDFATYYCQQAESFPWTFGQGTKVEIK

SEQ ID NO: 28639 - protein, 252 aa, Artificial Sequence
  Description of Artificial Sequence: Synthetic polypeptide
  XENPA83 (XENP022869 [ICOS]_H0.61_L0.43 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQAESFPWTFGQGTKVEIK

SEQ ID NO: 28640 - protein, 252 aa, Artificial Sequence
  Description of Artificial Sequence: Synthetic polypeptide
  XENPA84 (XENP022870 [ICOS]_H0.61_L0.44 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSYLAWYQQKPGKAPKLLIYAASSLQSGVPSRFSGSGSGTDFTLTISSLQPEDFATYYCQQANSFPWTFGQGTKVEIK

SEQ ID NO: 28641 - protein, 252 aa, Artificial Sequence
  Description of Artificial Sequence: Synthetic polypeptide
  XENPA85 (XENP022871 [ICOS]_H0.24_L0.38 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDIWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28642 - protein, 252 aa, Artificial Sequence
  Description of Artificial Sequence: Synthetic polypeptide
  XENPA86 (XENP022872 [ICOS]_H0.37_L0.38 scFv)
QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28643 - protein, 252 aa, Artificial Sequence
  Description of Artificial Sequence: Synthetic polypeptide
  XENPA87 (XENP022873 [ICOS]_H0.40_L0.38 scFv)
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28644 - protein, 252 aa, Artificial Sequence
  Description of Artificial Sequence: Synthetic polypeptide
  XENPA88 (XENP022874 [ICOS]_H0.44_L0.38 scFv)
QVQLVQSGAEVKKPGASVKVSCKASGYTFTGYYMHWVRQAPGQGLEWMGWINPHSGGTNYAQKFQGRVTITADESTSTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28645 - protein, 252 aa, Artificial Sequence
  Description of Artificial Sequence: Synthetic polypeptide
  XENPA89 (XENP022875 [ICOS]_H0.56_L0.38 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDIWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28646 - protein, 252 aa, Artificial Sequence
  Description of Artificial Sequence: Synthetic polypeptide
  XENPA90 (XENP022876 [ICOS]_H0.62_L0.38 scFv)
QVQLVQSGAEVKKPGASVKVSCKASGYTFTGYYMHWVRQAPGQGLEWMGWINPHSGGTNYAQKFQGRVTMTEDTSTDTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQAESFPWTFGQGTKVEIK

SEQ ID NO: 28647 - protein, 252 aa, Artificial Sequence
  Description of Artificial Sequence: Synthetic polypeptide
  XENPA91 (XENP022929 [ICOS]_H0.35_L0.36 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYVASSLQSGVPSRFSGSGSGTDFTLTISSLQPEDFATYYCQQAESFPWTFGQGTKVEIK

SEQ ID NO: 28648 - protein, 252 aa, Artificial Sequence
  Description of Artificial Sequence: Synthetic polypeptide
  XENPA92 (XENP022930 [ICOS]_H0.61_L0.36 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYVASSLQSGVPSRFSGSGSGTDFTLTISSLQPEDFATYYCQQAESFPWTFGQGTKVEIK

SEQ ID NO: 28649 - protein, 252 aa, Artificial Sequence
  Description of Artificial Sequence: Synthetic polypeptide
  XENPA93 (XENP022938 [ICOS]_H0.24_L0.37 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDIWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28650 - protein, 252 aa, Artificial Sequence
  Description of Artificial Sequence: Synthetic polypeptide
  XENPA94 (XENP022939 [ICOS]_H0.37_L0.37 scFv)
QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28651 - protein, 252 aa, Artificial Sequence
  Description of Artificial Sequence: Synthetic polypeptide
  XENPA95 (XENP022940 [ICOS]_H0.40_L0.37 scFv)
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28652 - protein, 252 aa, Artificial Sequence
  Description of Artificial Sequence: Synthetic polypeptide
  XENPA96 (XENP022941 [ICOS]_H0.44_L0.37 scFv)
QVQLVQSGAEVKKPGASVKVSCKASGYTFTGYYMHWVRQAPGQGLEWMGWINPHSGGTNYAQKFQGRVTITADESTSTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28653 - protein, 252 aa, Artificial Sequence
  Description of Artificial Sequence: Synthetic polypeptide
  XENPA97 (XENP022942 [ICOS]_H0.56_L0.37 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDIWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28654 - protein, 252 aa, Artificial Sequence
  Description of Artificial Sequence: Synthetic polypeptide
  XENPA98 (XENP022943 [ICOS]_H0.62_L0.37 scFv)
QVQLVQSGAEVKKPGASVKVSCKASGYTFTGYYMHWVRQAPGQGLEWMGWINPHSGGTNYAQKFQGRVTMTEDTSTDTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28655 - protein, 252 aa, Artificial Sequence
  Description of Artificial Sequence: Synthetic polypeptide
  XENPA99 (XENP022944 [ICOS]_H0.35_L0.34 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIK

SEQ ID NO: 28656 - protein, 252 aa, Artificial Sequence
  Description of Artificial Sequence: Synthetic polypeptide
  XENPA100 (XENP022945 [ICOS]_H0.35_L0.35 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQANSFPWTFGQGTKVEIK

SEQ ID NO: 28657 - protein, 252 aa, Artificial Sequence
  Description of Artificial Sequence: Synthetic polypeptide
  XENPA101 (XENP022946 [ICOS]_H0.35_L0.37 scFv)
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28658 - protein, 252 aa, Artificial Sequence
  Description of Artificial Sequence: Synthetic polypeptide
  XENPA102 (XENP022947 [ICOS]_H0.61_L0.34 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIK

SEQ ID NO: 28659 - protein, 252 aa, Artificial Sequence
  Description of Artificial Sequence: Synthetic polypeptide
  XENPA103 (XENP022948 [ICOS]_H0.61_L0.35 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISSLLAWYQQKPGKAPKLLIYAASSLQSGVPSRFSGSGSGTDFTLTISSLQPEDFATYYCQQANSFPWTFGQGTKVEIK

SEQ ID NO: 28660 - protein, 252 aa, Artificial Sequence
  Description of Artificial Sequence: Synthetic polypeptide
  XENPA104 (XENP022949 [ICOS]_H0.61_L0.37 scFv)
QVQLVQSGAEVKKPGASVKVSCKASGYTFTGYYMHWVRQAPGQGLEWMGIINPHSGGTNYAQKFQGRVTMTRDTSISTAYMELSRLRSDDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYAASSLQSGVPSRFSGSGSGTDFTLTISSLQPEDFATYYCQQAESFPWTFGQGTKVEIK

SEQ ID NO: 28661 - protein, 252 aa, Artificial Sequence
  Description of Artificial Sequence: Synthetic polypeptide
  XENPA105 (XENP023086 [ICOS]_H0.37_L0 scFv)
QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28662 - protein, 252 aa, Artificial Sequence
  Description of Artificial Sequence: Synthetic polypeptide
  XENPA106 (XENP023087 [ICOS]_H0.64_L0 scFv)
QVQLVQSGAEVKKPGASVKVSCKASGYTFTGYYMHWVRQAPGQGLEWMGWINPHSGGTNYAQKFQGRVTMTEDTSTDTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28663 - protein, 252 aa, Artificial Sequence
  Description of Artificial Sequence: Synthetic polypeptide
  XENPA107 (XENP023088 [ICOS]_H0.66_L0 scFv)
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28664 - protein, 252 aa, Artificial Sequence
  Description of Artificial Sequence: Synthetic polypeptide
  XENPA108 (XENP023089 [ICOS]_H0.67_L0 scFv)
QVQLVQSGAEVKKPGASVKVSCKASGYTFTGYYMHWVRQAPGQGLEWMGWINPHSGETIYAQKFQGRVTMTEDTSTDTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIK

SEQ ID NO: 28665 - protein, 252 aa, Artificial Sequence
  Description of Artificial Sequence: Synthetic polypeptide
  XENPA109 (XENP023409 [ICOS]_H0.66_L0.34 scFv)
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCQASQDISRLLAWYQQKPGKAPKLLIYVASSLQSGVPSRFSGSGSGTDFTLTISSLQPEDFATYYCQQAESFPWTFGQGTKVEIK

SEQ ID NO: 28666 - protein, 6 aa, Artificial Sequence
  Description of Artificial Sequence: Synthetic 6xHis tag
HHHHHH

SEQ ID NO: 28667 - protein, 13 aa, Artificial Sequence
  Description of Artificial Sequence: Synthetic peptide
ASTKGPSVFPLAP

SEQ ID NO: 28668 - protein, 13 aa, Artificial Sequence
  Description of Artificial Sequence: Synthetic peptide
RTVAAPSVFIFPP

SEQ ID NO: 28669 - protein, 329 aa, Artificial Sequence
  Description of Artificial Sequence: Synthetic polypeptide
  Fab side heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28670 - protein, 231 aa, Artificial Sequence; identical to SEQ ID NO: 2397
  Description of Artificial Sequence: Synthetic polypeptide
  scFv heavy chain

SEQ ID NO: 28671 - protein, 107 aa, Artificial Sequence [sequence omitted]

SEQ ID NO: 28672 - protein, 329 aa, Artificial Sequence; identical to SEQ ID NO: 28669
  Description of Artificial Sequence: Synthetic polypeptide
  Fab side heavy chain

SEQ ID NO: 28673 - protein, 231 aa, Artificial Sequence
  Description of Artificial Sequence: Synthetic polypeptide
  scFv heavy chain
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28674 - protein, 329 aa, Artificial Sequence
  Description of Artificial Sequence: Synthetic polypeptide
  Fab side heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 28675 - protein, 231 aa, Artificial Sequence; identical to SEQ ID NO: 28673
  Description of Artificial Sequence: Synthetic polypeptide
  scFv heavy chain

SEQ ID NO: 28676 - protein, 330 aa, Artificial Sequence
  Description of Artificial Sequence: Synthetic polypeptide
  Fab side heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKSGFYPSDIAVEWESDGQPENNYKTTPPVLDSDGSFFLYSKLEVDKSRWEQGDVFSCSVMHEALHNHYTQKSLSLSPGK

SEQ ID NO: 28677 - protein, 231 aa, Artificial Sequence
  Description of Artificial Sequence: Synthetic polypeptide
  scFv heavy chain
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 28678 - protein, 329 aa, Artificial Sequence
  Description of Artificial Sequence: Synthetic polypeptide
  Fab side heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28679 - protein, 231 aa, Artificial Sequence
  Description of Artificial Sequence: Synthetic polypeptide
  scFv heavy chain
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28680 - protein, 329 aa, Artificial Sequence
  Description of Artificial Sequence: Synthetic polypeptide
  Fab side heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28681 - protein, 231 aa, Artificial Sequence; identical to SEQ ID NO: 28679
  Description of Artificial Sequence: Synthetic polypeptide
  scFv heavy chain

SEQ ID NO: 28682 - protein, 329 aa, Artificial Sequence
  Description of Artificial Sequence: Synthetic polypeptide
  Fab side heavy chain
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 28683 - protein, 231 aa, Artificial Sequence
  Description of Artificial Sequence: Synthetic polypeptide
  scFv heavy chain
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28684 - protein, 327 aa, Artificial Sequence
  Description of Artificial Sequence: Synthetic polypeptide
  Fab side heavy chain
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVKQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSKLTVDKSRWEEGDVFSCSVMHEALHNHYTQKSLSLSLGK

SEQ ID NO: 28685 - protein, 229 aa, Artificial Sequence
  Description of Artificial Sequence: Synthetic polypeptide
  scFv heavy chain
ESKYGPPCPPCPAPEFLGGPSVFLFPPKPKDTLMISRTPEVTCVVVDVKQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 28686 - protein, 326 aa, Artificial Sequence
  Description of Artificial Sequence: Synthetic polypeptide
  Fab side heavy chain
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 28687 - protein, 228 aa, Artificial Sequence
  Description of Artificial Sequence: Synthetic polypeptide
  scFv heavy chain
ERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 28688 - protein, 326 aa, Artificial Sequence
  Description of Artificial Sequence: Synthetic polypeptide
  Fab side heavy chain
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 28689 - protein, 228 aa, Artificial Sequence
  Description of Artificial Sequence: Synthetic polypeptide
  scFv heavy chain
ERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 28690 - protein, 113 aa, Artificial Sequence [sequence omitted]

SEQ ID NO: 28691 - protein, 5 aa, Artificial Sequence
  Description of Artificial Sequence: Synthetic peptide
  XENP016432 vhCDR1
NSGMH

SEQ ID NO: 28692 - protein, 17 aa, Artificial Sequence
  Description of Artificial Sequence: Synthetic peptide
  XENP016432 vhCDR2
VIWYDGSKRYYADSVKG

SEQ ID NO: 28693 - protein, 4 aa, Artificial Sequence
  Description of Artificial Sequence: Synthetic peptide
  XENP016432 vhCDR3
NDDY

SEQ ID NO: 28694 - protein, 442 aa, Artificial Sequence; identical to SEQ ID NO: 16161
  Description of Artificial Sequence: Synthetic polypeptide
  XENP016432 Full length HC

SEQ ID NO: 28695 - protein, 107 aa, Artificial Sequence [sequence omitted]

SEQ ID NO: 28696 - protein, 11 aa, Artificial Sequence
  Description of Artificial Sequence: Synthetic peptide
  XENP016432 vlCDR1
RASQSVSSYLA

SEQ ID NO: 28697 - protein, 7 aa, Artificial Sequence
  Description of Artificial Sequence: Synthetic peptide
  XENP016432 vlCDR2
DASNRAT

SEQ ID NO: 28698 - protein, 9 aa, Artificial Sequence
  Description of Artificial Sequence: Synthetic peptide
  XENP016432 vlCDR3
QQSSNWPRT

SEQ ID NO: 28699 - protein, 214 aa, Artificial Sequence; identical to SEQ ID NO: 16146
  Description of Artificial Sequence: Synthetic polypeptide
  XENP016432 Full length light chain

SEQ ID NO: 28700 - protein, 127 aa, Artificial Sequence; identical to SEQ ID NO: 26823
  Description of Artificial Sequence: Synthetic polypeptide
  VH of XENP024120

SEQ ID NO: 28701 - protein, 7 aa, Artificial Sequence
  Description of Artificial Sequence: Synthetic peptide
  XENP024120 vhCDR1
SGAYYWS

SEQ ID NO: 28702 - protein, 16 aa, Artificial Sequence
  Description of Artificial Sequence: Synthetic peptide
  XENP024120 vhCDR2
YIYYNGNTYYNPSLRS

SEQ ID NO: 28703 - protein, 17 aa, Artificial Sequence
  Description of Artificial Sequence: Synthetic peptide
  XENP024120 vhCDR3
ASDYVWGGYHYFDAFDL

SEQ ID NO: 28704 - protein, 456 aa, Artificial Sequence; identical to SEQ ID NO: 27536
  Description of Artificial Sequence: Synthetic polypeptide
  XENP024120 Full length HC

SEQ ID NO: 28705 - protein, 110 aa, Artificial Sequence; identical to SEQ ID NO: 26838
  Description of Artificial Sequence: Synthetic polypeptide
  VL of XENP024120

SEQ ID NO: 28706 - protein, 13 aa, Artificial Sequence
  Description of Artificial Sequence: Synthetic peptide
  XENP024120 vlCDR1
SGSNSNIGSNSVN

SEQ ID NO: 28707 - protein, 7 aa, Artificial Sequence
  Description of Artificial Sequence: Synthetic peptide
  XENP024120 vlCDR2
GNNQRPS

SEQ ID NO: 28708 - protein, 11 aa, Artificial Sequence
  Description of Artificial Sequence: Synthetic peptide
  XENP024120 vlCDR3
AAWDDSLNGPV

SEQ ID NO: 28709 - protein, 216 aa, Artificial Sequence; identical to SEQ ID NO: 26837
  Description of Artificial Sequence: Synthetic polypeptide
  XENP024120 Full length light chain

SEQ ID NO: 28710 - protein, 123 aa, Artificial Sequence; identical to SEQ ID NO: 26303
  Description of Artificial Sequence: Synthetic polypeptide
  VH of XENP024121

SEQ ID NO: 28711 - protein, 5 aa, Artificial Sequence
  Description of Artificial Sequence: Synthetic peptide
  XENP024121 vhCDR1
TYWMH

SEQ ID NO: 28712 - protein, 17 aa, Artificial Sequence
  Description of Artificial Sequence: Synthetic peptide
  XENP024121 vhCDR2
EIDPSDSYVNYNQNFKG

SEQ ID NO: 28713 - protein, 14 aa, Artificial Sequence
  Description of Artificial Sequence: Synthetic peptide
  XENP024121 vhCDR3
SPDYYGTSLAWFDY

SEQ ID NO: 28714 - protein, 452 aa, Artificial Sequence; identical to SEQ ID NO: 26682
  Description of Artificial Sequence: Synthetic polypeptide
  XENP024121 Full length HC

SEQ ID NO: 28715 - protein, 111 aa, Artificial Sequence; identical to SEQ ID NO: 27008
  Description of Artificial Sequence: Synthetic polypeptide
  VL of XENP024121

SEQ ID NO: 28716 - protein, 15 aa, Artificial Sequence
  Description of Artificial Sequence: Synthetic peptide
  XENP024121 vlCDR1
RASESVDNYGMSFMN

SEQ ID NO: 28717 - protein, 7 aa, Artificial Sequence
  Description of Artificial Sequence: Synthetic peptide
  XENP024121 vlCDR2
AASNQGS

SEQ ID NO: 28718 - protein, 9 aa, Artificial Sequence
  Description of Artificial Sequence: Synthetic peptide
  XENP024121 vlCDR3
QQSKEVPYT

SEQ ID NO: 28719 - protein, 218 aa, Artificial Sequence; identical to SEQ ID NO: 27551
  Description of Artificial Sequence: Synthetic polypeptide
  XENP024121 Full length light chain

SEQ ID NO: 28720 - protein, 122 aa, Artificial Sequence; identical to SEQ ID NO: 2872
  Description of Artificial Sequence: Synthetic polypeptide
  VH of XENP019686

SEQ ID NO: 28721 - protein, 5 aa, Artificial Sequence
  Description of Artificial Sequence: Synthetic peptide
  XENP019686 vhCDR1
NYWMN

SEQ ID NO: 28722 - protein, 19 aa, Artificial Sequence
  Description of Artificial Sequence: Synthetic peptide
  XENP019686 vhCDR2
EIRLYSNNYATHYAESVKG

SEQ ID NO: 28723 - protein, 11 aa, Artificial Sequence
  Description of Artificial Sequence: Synthetic peptide
  XENP019686 vhCDR3
YYGNYGGYFDV

SEQ ID NO: 28724 - protein, 451 aa, Artificial Sequence; identical to SEQ ID NO: 21381
  Description of Artificial Sequence: Synthetic polypeptide
  XENP019686 Full length HC

SEQ ID NO: 28725 - protein, 107 aa, Artificial Sequence; identical to SEQ ID NO: 2871
  Description of Artificial Sequence: Synthetic polypeptide
  VL of XENP019686

SEQ ID NO: 28726 - protein, 11 aa, Artificial Sequence
  Description of Artificial Sequence: Synthetic peptide
  XENP019686 vlCDR1
RASQSVGNDVA

SEQ ID NO: 28727 - protein, 7 aa, Artificial Sequence
  Description of Artificial Sequence: Synthetic peptide
  XENP019686 vlCDR2
YASHRYT

SEQ ID NO: 28728 - protein, 9 aa, Artificial Sequence
  Description of Artificial Sequence: Synthetic peptide
  XENP019686 vlCDR3
QQDFSSPRT

SEQ ID NO: 28729 - protein, 214 aa, Artificial Sequence; identical to SEQ ID NO: 21486
  Description of Artificial Sequence: Synthetic polypeptide
  XENP019686 Full length light chain

SEQ ID NO: 28730 - protein, 120 aa, Artificial Sequence; identical to SEQ ID NO: 3091
  Description of Artificial Sequence: Synthetic polypeptide
  VH of XENP020156

SEQ ID NO: 28731 - protein, 5 aa, Artificial Sequence
  Description of Artificial Sequence: Synthetic peptide
  XENP020156 vhCDR1
NYWLG

SEQ ID NO: 28732 - protein, 17 aa, Artificial Sequence
  Description of Artificial Sequence: Synthetic peptide
  XENP020156 vhCDR2
NFYPGSSNTYYNEKFQG

SEQ ID NO: 28733 - protein, 11 aa, Artificial Sequence
  Description of Artificial Sequence: Synthetic peptide
  XENP020156 vhCDR3
HYGTNYRYFDV

SEQ ID NO: 28734 - protein, 449 aa, Artificial Sequence; identical to SEQ ID NO: 21751
  Description of Artificial Sequence: Synthetic polypeptide
  XENP020156 Full length HC

SEQ ID NO: 28735 - protein, 107 aa, Artificial Sequence; identical to SEQ ID NO: 3092
  Description of Artificial Sequence: Synthetic polypeptide
  VL of XENP020156

SEQ ID NO: 28736 - protein, 11 aa, Artificial Sequence
  Description of Artificial Sequence: Synthetic peptide
  XENP020156 vlCDR1
RASQSVSNDVA

SEQ ID NO: 28737 - protein, 7 aa, Artificial Sequence
  Description of Artificial Sequence: Synthetic peptide
  XENP020156 vlCDR2
YASNRYT

SEQ ID NO: 28738 - protein, 9 aa, Artificial Sequence
  Description of Artificial Sequence: Synthetic peptide
  XENP020156 vlCDR3
QQDYSSPYT

SEQ ID NO: 28739 - protein, 214 aa, Artificial Sequence; identical to SEQ ID NO: 3140
  Description of Artificial Sequence: Synthetic polypeptide
  XENP020156 Full length light chain

SEQ ID NO: 28740 - protein, 122 aa, Artificial Sequence; identical to SEQ ID NO: 2872
  Description of Artificial Sequence: Synthetic polypeptide
  VH of XENP19690

SEQ ID NO: 28741 - protein, 5 aa, Artificial Sequence
  Description of Artificial Sequence: Synthetic peptide
  XENP19690 vhCDR1
NYWMN

SEQ ID NO: 28742 - protein, 19 aa, Artificial Sequence
  Description of Artificial Sequence: Synthetic peptide
  XENP19690 vhCDR2
EIRLYSNNYATHYAESVKG

SEQ ID NO: 28743 - protein, 11 aa, Artificial Sequence
  Description of Artificial Sequence: Synthetic peptide
  XENP19690 vhCDR3
YYGNYGGYFDV

SEQ ID NO: 28744 - protein, 20 aa, Artificial Sequence
  Description of Artificial Sequence: Synthetic peptide
  XENP19690 scFv
GKPGSGKPGSGKPGSGKPGS

SEQ ID NO: 28745 - protein, 107 aa, Artificial Sequence; identical to SEQ ID NO: 2871
  Description of Artificial Sequence: Synthetic polypeptide
  VL of XENP19690

SEQ ID NO: 28746 - protein, 11 aa, Artificial Sequence
  Description of Artificial Sequence: Synthetic peptide
  XENP19690 vlCDR1
RASQSVGNDVA

SEQ ID NO: 28747 - protein, 7 aa, Artificial Sequence
  Description of Artificial Sequence: Synthetic peptide
  XENP19690 vlCDR2
YASHRYT

SEQ ID NO: 28748 - protein, 9 aa, Artificial Sequence
  Description of Artificial Sequence: Synthetic peptide
  XENP19690 vlCDR3
QQDFSSPRT

SEQ ID NO: 28749 - protein, 249 aa, Artificial Sequence; identical to SEQ ID NO: 16051
  Description of Artificial Sequence: Synthetic polypeptide
  XENP19690 scFv

SEQ ID NO: 28750 - protein, 122 aa, Artificial Sequence; identical to SEQ ID NO: 15593
  Description of Artificial Sequence: Synthetic polypeptide

SEQ ID NO: 28751 - protein, 5 aa, Artificial Sequence
  Description of Artificial Sequence: Synthetic peptide
NYWMN

SEQ ID NO: 28752 - protein, 19 aa, Artificial Sequence
  Description of Artificial Sequence: Synthetic peptide
EIRLYSNNYATHYAESVKG

SEQ ID NO: 28753 - protein, 11 aa, Artificial Sequence
  Description of Artificial Sequence: Synthetic peptide
YYGNYGGYFDV

SEQ ID NO: 28754 - protein, 20 aa, Artificial Sequence
  Description of Artificial Sequence: Synthetic peptide
GKPGSGKPGSGKPGSGKPGS

SEQ ID NO: 28755 - protein, 107 aa, Artificial Sequence
  Description of Artificial Sequence: Synthetic polypeptide
EIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIK

SEQ ID NO: 28756 - protein, 11 aa, Artificial Sequence
  Description of Artificial Sequence: Synthetic peptide
RASQSVGNDVA

SEQ ID NO: 28757 - protein, 7 aa, Artificial Sequence
  Description of Artificial Sequence: Synthetic peptide
YASHRYT

SEQ ID NO: 28758 - protein, 9 aa, Artificial Sequence
  Description of Artificial Sequence: Synthetic peptide
QQDWSSPRT

SEQ ID NO: 28759 - protein, 249 aa, Artificial Sequence
  Description of Artificial Sequence: Synthetic polypeptide
EVQLVESGGGLVKPGGSLRLTCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSGKPGSGKPGSGKPGSGKPGSEIVLTQSPATLSVSPGERVTLTCRASQSVGNDVAWYQQKPGQAPRLLINYASHRYTSVPDRFTGSGYGTEFTLTISSVQSEDFAVYYCQQDWSSPRTFGGGTKVEIK

SEQ ID NO: 28760 - protein, 107 aa, Artificial Sequence; identical to SEQ ID NO: 2871
  Description of Artificial Sequence: Synthetic polypeptide
  VH of XENP19692

SEQ ID NO: 28761 - protein, 11 aa, Artificial Sequence
  Description of Artificial Sequence: Synthetic peptide
  XENP19692 vhCDR1
RASQSVGNDVA

SEQ ID NO: 28762 - protein, 7 aa, Artificial Sequence
  Description of Artificial Sequence: Synthetic peptide
  XENP19692 vhCDR2
YASHRYT

SEQ ID NO: 28763 - protein, 9 aa, Artificial Sequence
  Description of Artificial Sequence: Synthetic peptide
  XENP19692 vhCDR3
QQDFSSPRT

SEQ ID NO: 28764 - protein, 20 aa, Artificial Sequence
  Description of Artificial Sequence: Synthetic peptide
  XENP19692 scFv
GKPGSGKPGSGKPGSGKPGS

SEQ ID NO: 28765 - protein, 122 aa, Artificial Sequence; identical to SEQ ID NO: 2872
  Description of Artificial Sequence: Synthetic polypeptide
  VL of XENP19692

SEQ ID NO: 28766 - protein, 5 aa, Artificial Sequence
  Description of Artificial Sequence: Synthetic peptide
  XENP19692 vlCDR1
NYWMN

SEQ ID NO: 28767 - protein, 19 aa, Artificial Sequence
  Description of Artificial Sequence: Synthetic peptide
  XENP19692 vlCDR2
EIRLYSNNYATHYAESVKG

SEQ ID NO: 28768 - protein, 11 aa, Artificial Sequence
  Description of Artificial Sequence: Synthetic peptide
  XENP19692 vlCDR3
YYGNYGGYFDV

SEQ ID NO: 28769 - protein, 249 aa, Artificial Sequence; identical to SEQ ID NO: 16069
  Description of Artificial Sequence: Synthetic polypeptide
  XENP19692 scFv

SEQ ID NO: 28770 - protein, 107 aa, Artificial Sequence; identical to SEQ ID NO: 16035
  Description of Artificial Sequence: Synthetic polypeptide
  VH of XENP19669

SEQ ID NO: 28771 - protein, 11 aa, Artificial Sequence
  Description of Artificial Sequence: Synthetic peptide
  XENP19669 vhCDR1
RASQSVGNDVA

SEQ ID NO: 28772 - protein, 7 aa, Artificial Sequence
  Description of Artificial Sequence: Synthetic peptide
  XENP19669 vhCDR2
YASHRYT

SEQ ID NO: 28773 - protein, 9 aa, Artificial Sequence
  Description of Artificial Sequence: Synthetic peptide
  XENP19669 vhCDR3
QQDFSSPRT

SEQ ID NO: 28774 - protein, 20 aa, Artificial Sequence
  Description of Artificial Sequence: Synthetic peptide
  XENP19669 scFv
GKPGSGKPGSGKPGSGKPGS

SEQ ID NO: 28775 - protein, 122 aa, Artificial Sequence; identical to SEQ ID NO: 16034
  Description of Artificial Sequence: Synthetic polypeptide
  VL of XENP19669

SEQ ID NO: 28776 - protein, 5 aa, Artificial Sequence
  Description of Artificial Sequence: Synthetic peptide
  XENP19669 vlCDR1
NYWMN

SEQ ID NO: 28777 - protein, 19 aa, Artificial Sequence
  Description of Artificial Sequence: Synthetic peptide
  XENP19669 vlCDR2
EIRLYSNNYATHYAESVKG

SEQ ID NO: 28778 - protein, 11 aa, Artificial Sequence
  Description of Artificial Sequence: Synthetic peptide
  XENP19669 vlCDR3
YYGNYGGYFDV

SEQ ID NO: 28779 - protein, 249 aa, Artificial Sequence; identical to SEQ ID NO: 16042
  Description of Artificial Sequence: Synthetic polypeptide
  XENP19669 scFv

SEQ ID NO: 28780 - protein, 120 aa, Artificial Sequence; identical to SEQ ID NO: 3091
  Description of Artificial Sequence: Synthetic polypeptide
  VH of XENP20162

SEQ ID NO: 28781 - protein, 5 aa, Artificial Sequence
  Description of Artificial Sequence: Synthetic peptide
  XENP20162 vhCDR1
NYWLG

SEQ ID NO: 28782 - protein, 17 aa, Artificial Sequence
  Description of Artificial Sequence: Synthetic peptide
  XENP20162 vhCDR2
NFYPGSSNTYYNEKFQG

SEQ ID NO: 28783 - protein, 11 aa, Artificial Sequence
  Description of Artificial Sequence: Synthetic peptide
  XENP20162 vhCDR3
HYGTNYRYFDV

SEQ ID NO: 28784 - protein, 20 aa, Artificial Sequence
  Description of Artificial Sequence: Synthetic peptide
  XENP20162 scFv
GKPGSGKPGSGKPGSGKPGS

SEQ ID NO: 28785 - protein, 107 aa, Artificial Sequence; identical to SEQ ID NO: 3092
  Description of Artificial Sequence: Synthetic polypeptide
  VL of XENP20162

SEQ ID NO: 28786 - protein, 11 aa, Artificial Sequence
  Description of Artificial Sequence: Synthetic peptide
  XENP20162 vlCDR1
RASQSVSNDVA

SEQ ID NO: 28787 - protein, 7 aa, Artificial Sequence
  Description of Artificial Sequence: Synthetic peptide
  XENP20162 vlCDR2
YASNRYT

SEQ ID NO: 28788 - protein, 9 aa, Artificial Sequence
  Description of Artificial Sequence: Synthetic peptide
  XENP20162 vlCDR3
QQDYSSPYT

SEQ ID NO: 28789 - protein, 247 aa, Artificial Sequence; identical to SEQ ID NO: 16087
  Description of Artificial Sequence: Synthetic polypeptide
  XENP20162 scFv

SEQ ID NO: 28790 - protein, 118 aa, Artificial Sequence; identical to SEQ ID NO: 5085
  Description of Artificial Sequence: Synthetic polypeptide
  VH of XENP19235 Fab, XENP19769 scFv

SEQ ID NO: 28791 - protein, 5 aa, Artificial Sequence
  Description of Artificial Sequence: Synthetic peptide
  XENP19235 Fab, XENP19769 scFv vhCDR1
SYAMH

SEQ ID NO: 28792 - protein, 17 aa, Artificial Sequence
  Description of Artificial Sequence: Synthetic peptide
  XENP19235 Fab, XENP19769 scFv vhCDR2
FISYDGNNKYYADSVKG

SEQ ID NO: 28793 - protein, 9 aa, Artificial Sequence
  Description of Artificial Sequence: Synthetic peptide
  XENP19235 Fab, XENP19769 scFv vhCDR3
TGWLGPFDY

SEQ ID NO: 28794 - protein, 20 aa, Artificial Sequence
  Description of Artificial Sequence: Synthetic peptide
  XENP19235 Fab, XENP19769 scFv scFv linker
GKPGSGKPGSGKPGSGKPGS

SEQ ID NO: 28795 - protein, 108 aa, Artificial Sequence; identical to SEQ ID NO: 3741
  Description of Artificial Sequence: Synthetic polypeptide
  VL of XENP19235 Fab, XENP19769 scFv

SEQ ID NO: 28796 - protein, 12 aa, Artificial Sequence
  Description of Artificial Sequence: Synthetic peptide
  XENP19235 Fab, XENP19769 scFv vlCDR1
RASQSVGSSYLA

SEQ ID NO: 28797 - protein, 7 aa, Artificial Sequence
  Description of Artificial Sequence: Synthetic peptide
  XENP19235 Fab, XENP19769 scFv vlCDR2
GAFSRAT

SEQ ID NO: 28798 - protein, 9 aa, Artificial Sequence
  Description of Artificial Sequence: Synthetic peptide
  XENP19235 Fab, XENP19769 scFv vlCDR3
QQYGSSPWT

SEQ ID NO: 28799 - protein, 246 aa, Artificial Sequence; identical to SEQ ID NO: 5084
  Description of Artificial Sequence: Synthetic polypeptide
  XENP19235 Fab, XENP19769 scFv scFv

SEQ ID NO: 28800 - protein, 118 aa, Artificial Sequence; identical to SEQ ID NO: 5094
  Description of Artificial Sequence: Synthetic polypeptide
  VH of XENP19236 Fab, XENP19770 scFv

SEQ ID NO: 28801 - protein, 5 aa, Artificial Sequence
  Description of Artificial Sequence: Synthetic peptide
  XENP19236 Fab, XENP19770 scFv vhCDR1
SYGMH

SEQ ID NO: 28802 - protein, 17 aa, Artificial Sequence
  Description of Artificial Sequence: Synthetic peptide
  XENP19236 Fab, XENP19770 scFv vhCDR2
FISYDGNNKYYADSVKG

SEQ ID NO: 28803 - protein, 9 aa, Artificial Sequence
  Description of Artificial Sequence: Synthetic peptide
  XENP19236 Fab, XENP19770 scFv vhCDR3
TGWLGPFDY

SEQ ID NO: 28804 - protein, 20 aa, Artificial Sequence
  Description of Artificial Sequence: Synthetic peptide
  XENP19236 Fab, XENP19770 scFv scFv linker
GKPGSGKPGSGKPGSGKPGS

SEQ ID NO: 28805 - protein, 108 aa, Artificial Sequence; identical to SEQ ID NO: 3741
  Description of Artificial Sequence: Synthetic polypeptide
  VL of XENP19236 Fab, XENP19770 scFv

SEQ ID NO: 28806 - protein, 12 aa, Artificial Sequence
  Description of Artificial Sequence: Synthetic peptide
  XENP19236 Fab, XENP19770 scFv vlCDR1
RASQSVGSSYLA

SEQ ID NO: 28807 - protein, 7 aa, Artificial Sequence
  Description of Artificial Sequence: Synthetic peptide
  XENP19236 Fab, XENP19770 scFv vlCDR2
GAFSRAT

SEQ ID NO: 28808 - protein, 9 aa, Artificial Sequence
  Description of Artificial Sequence: Synthetic peptide
  XENP19236 Fab, XENP19770 scFv vlCDR3
QQYGSSPWT

SEQ ID NO: 28809 - protein, 246 aa, Artificial Sequence; identical to SEQ ID NO: 5093
  Description of Artificial Sequence: Synthetic polypeptide
  XENP19236 Fab, XENP19770 scFv scFv

SEQ ID NO: 28810 - protein, 118 aa, Artificial Sequence; identical to SEQ ID NO: 5103
  Description of Artificial Sequence: Synthetic polypeptide
  VH of XENP19237 Fab, XENP19771 scFv

SEQ ID NO: 28811 - protein, 5 aa, Artificial Sequence
  Description of Artificial Sequence: Synthetic peptide
  XENP19237 Fab, XENP19771 scFv vhCDR1
SYSMH

SEQ ID NO: 28812 - protein, 17 aa, Artificial Sequence
  Description of Artificial Sequence: Synthetic peptide
  XENP19237 Fab, XENP19771 scFv vhCDR2
FISYDGNNKYYADSVKG

SEQ ID NO: 28813 - protein, 9 aa, Artificial Sequence
  Description of Artificial Sequence: Synthetic peptide
  XENP19237 Fab, XENP19771 scFv vhCDR3
TGWLGPFDY

SEQ ID NO: 28814 - protein, 20 aa, Artificial Sequence
  Description of Artificial Sequence: Synthetic peptide
  XENP19237 Fab, XENP19771 scFv scFv linker
GKPGSGKPGSGKPGSGKPGS

SEQ ID NO: 28815 - protein, 108 aa, Artificial Sequence; identical to SEQ ID NO: 3741
  Description of Artificial Sequence: Synthetic polypeptide
  VL of XENP19237 Fab, XENP19771 scFv

SEQ ID NO: 28816 - protein, 12 aa, Artificial Sequence
  Description of Artificial Sequence: Synthetic peptide
  XENP19237 Fab, XENP19771 scFv vlCDR1
RASQSVGSSYLA

SEQ ID NO: 28817 - protein, 7 aa, Artificial Sequence
  Description of Artificial Sequence: Synthetic peptide
  XENP19237 Fab, XENP19771 scFv vlCDR2
GAFSRAT

SEQ ID NO: 28818 - protein, 9 aa, Artificial Sequence
  Description of Artificial Sequence: Synthetic peptide
  XENP19237 Fab, XENP19771 scFv vlCDR3
QQYGSSPWT

SEQ ID NO: 28819 - protein, 246 aa, Artificial Sequence; identical to SEQ ID NO: 5102
  Description of Artificial Sequence: Synthetic polypeptide
  XENP19237 Fab, XENP19771 scFv scFv

SEQ ID NO: 28820 - protein, 20 aa, Artificial Sequence
  Description of Artificial Sequence: Synthetic peptide
  Fab XENP19773, scFv XENP19239 scFv linker
GKPGSGKPGSGKPGSGKPGS

SEQ ID NO: 28821 - protein, 246 aa, Artificial Sequence; identical to SEQ ID NO: 5120
  Description of Artificial Sequence: Synthetic polypeptide
  Fab XENP19773, scFv XENP19239 scFv

SEQ ID NO: 28822 - protein, 118 aa, Artificial Sequence; identical to SEQ ID NO: 5202
  Description of Artificial Sequence: Synthetic polypeptide
  VH of Fab XENP19248, scFv XENP19782

SEQ ID NO: 28823 - protein, 5 aa, Artificial Sequence
  Description of Artificial Sequence: Synthetic peptide
  Fab XENP19248, scFv XENP19782 vhCDR1
SYTMH

SEQ ID NO: 28824 - protein, 17 aa, Artificial Sequence
  Description of Artificial Sequence: Synthetic peptide
  Fab XENP19248, scFv XENP19782 vhCDR2
FISYDGNNKYYADSVKG

SEQ ID NO: 28825 - protein, 9 aa, Artificial Sequence
  Description of Artificial Sequence: Synthetic peptide
  Fab XENP19248, scFv XENP19782 vhCDR3
TGWLGPFDY

SEQ ID NO: 28826 - protein, 20 aa, Artificial Sequence
  Description of Artificial Sequence: Synthetic peptide
  Fab XENP19248, scFv XENP19782 scFv linker
GKPGSGKPGSGKPGSGKPGS

SEQ ID NO: 28827 - protein, 108 aa, Artificial Sequence; identical to SEQ ID NO: 3741
  Description of Artificial Sequence: Synthetic polypeptide
  VL of Fab XENP19248, scFv XENP19782

SEQ ID NO: 28828 - protein, 12 aa, Artificial Sequence
  Description of Artificial Sequence: Synthetic peptide
  Fab XENP19248, scFv XENP19782 vlCDR1
RASQSVGSSYLA

SEQ ID NO: 28829 - protein, 7 aa, Artificial Sequence
  Description of Artificial Sequence: Synthetic peptide
  Fab XENP19248, scFv XENP19782 vlCDR2
GAFSRAT

SEQ ID NO: 28830 - protein, 9 aa, Artificial Sequence
  Description of Artificial Sequence: Synthetic peptide
  Fab XENP19248, scFv XENP19782 vlCDR3
QQYGSSPWT

SEQ ID NO: 28831 - protein, 246 aa, Artificial Sequence; identical to SEQ ID NO: 5201
  Description of Artificial Sequence: Synthetic polypeptide
  Fab XENP19248, scFv XENP19782 scFv

SEQ ID NO: 28832 - protein, 118 aa, Artificial Sequence; identical to SEQ ID NO: 5211
  Description of Artificial Sequence: Synthetic polypeptide
  VH of Fab XENP19249, scFv XENP19783

SEQ ID NO: 28833 - protein, 5 aa, Artificial Sequence
  Description of Artificial Sequence: Synthetic peptide
  Fab XENP19249, scFv XENP19783 vhCDR1
SYTMH

SEQ ID NO: 28834 - protein, 17 aa, Artificial Sequence
  Description of Artificial Sequence: Synthetic peptide
  Fab XENP19249, scFv XENP19783 vhCDR2
FISYDGNNKYYADSVKG

SEQ ID NO: 28835 - protein, 9 aa, Artificial Sequence
  Description of Artificial Sequence: Synthetic peptide
  Fab XENP19249, scFv XENP19783 vhCDR3
TGWLGPFDY

SEQ ID NO: 28836 - protein, 20 aa, Artificial Sequence
  Description of Artificial Sequence: Synthetic peptide
  Fab XENP19249, scFv XENP19783 scFv linker
GKPGSGKPGSGKPGSGKPGS

SEQ ID NO: 28837 - protein, 108 aa, Artificial Sequence; identical to SEQ ID NO: 3741
  Description of Artificial Sequence: Synthetic polypeptide
  VL of Fab XENP19249, scFv XENP19783

SEQ ID NO: 28838 - protein, 12 aa, Artificial Sequence
  Description of Artificial Sequence: Synthetic peptide
  Fab XENP19249, scFv XENP19783 vlCDR1
RASQSVGSSYLA

SEQ ID NO: 28839 - protein, 7 aa, Artificial Sequence
  Description of Artificial Sequence: Synthetic peptide
  Fab XENP19249, scFv XENP19783 vlCDR2
GAFSRAT

SEQ ID NO: 28840 - protein, 9 aa, Artificial Sequence
  Description of Artificial Sequence: Synthetic peptide
  Fab XENP19249, scFv XENP19783 vlCDR3
QQYGSSPWT

SEQ ID NO: 28841 - protein, 246 aa, Artificial Sequence; identical to SEQ ID NO: 5210
  Description of Artificial Sequence: Synthetic polypeptide
  Fab XENP19249, scFv XENP19783 scFv

SEQ ID NO: 28842 - protein, 118 aa, Artificial Sequence; identical to SEQ ID NO: 5220
  Description of Artificial Sequence: Synthetic polypeptide
  VH of Fab XENP19250, scFv XENP19784

SEQ ID NO: 28843 - protein, 5 aa, Artificial Sequence
  Description of Artificial Sequence: Synthetic peptide
  Fab XENP19250, scFv XENP19784 vhCDR1
SYTMH

SEQ ID NO: 28844 - protein, 17 aa, Artificial Sequence
  Description of Artificial Sequence: Synthetic peptide
  Fab XENP19250, scFv XENP19784 vhCDR2
FISYDGNNKYYADSVKG

SEQ ID NO: 28845 - protein, 9 aa, Artificial Sequence
  Description of Artificial Sequence: Synthetic peptide
  Fab XENP19250, scFv XENP19784 vhCDR3
TGWLGPFDY

SEQ ID NO: 28846 - protein, 20 aa, Artificial Sequence
  Description of Artificial Sequence: Synthetic peptide
  Fab XENP19250, scFv XENP19784 scFv linker
GKPGSGKPGSGKPGSGKPGS

SEQ ID NO: 28847 - protein, 108 aa, Artificial Sequence; identical to SEQ ID NO: 3741
  Description of Artificial Sequence: Synthetic polypeptide
  VL of Fab XENP19250, scFv XENP19784

SEQ ID NO: 28848 - protein, 12 aa, Artificial Sequence
  Description of Artificial Sequence: Synthetic peptide
  Fab XENP19250, scFv XENP19784 vlCDR1
RASQSVGSSYLA

SEQ ID NO: 28849 - protein, 7 aa, Artificial Sequence
  Description of Artificial Sequence: Synthetic peptide
  Fab XENP19250, scFv XENP19784 vlCDR2
GAFSRAT

SEQ ID NO: 28850 - protein, 9 aa, Artificial Sequence
  Description of Artificial Sequence: Synthetic peptide
  Fab XENP19250, scFv XENP19784 vlCDR3
QQYGSSPWT

SEQ ID NO: 28851 - protein, 246 aa, Artificial Sequence; identical to SEQ ID NO: 5219
  Description of Artificial Sequence: Synthetic polypeptide
  Fab XENP19250, scFv XENP19784 scFv

SEQ ID NO: 28852 - protein, 118 aa, Artificial Sequence; identical to SEQ ID NO: 5490
  Description of Artificial Sequence: Synthetic polypeptide
  VH of Fab XENP19280, scFv XENP19818

SEQ ID NO: 28853 - protein, 5 aa, Artificial Sequence
  Description of Artificial Sequence: Synthetic peptide
  Fab XENP19280, scFv XENP19818 vhCDR1
SYTMH

SEQ ID NO: 28854 - protein, 17 aa, Artificial Sequence
  Description of Artificial Sequence: Synthetic peptide
  Fab XENP19280, scFv XENP19818 vhCDR2
FISYDGSNKYYADSVKG

SEQ ID NO: 28855 - protein, 9 aa, Artificial Sequence
  Description of Artificial Sequence: Synthetic peptide
  Fab XENP19280, scFv XENP19818 vhCDR3
TGWLGPFDY

SEQ ID NO: 28856 - protein, 20 aa, Artificial Sequence
  Description of Artificial Sequence: Synthetic peptide
  Fab XENP19280, scFv XENP19818 scFv linker
GKPGSGKPGSGKPGSGKPGS

SEQ ID NO: 28857 - protein, 108 aa, Artificial Sequence; identical to SEQ ID NO: 3741
  Description of Artificial Sequence: Synthetic polypeptide
  VL of Fab XENP19280, scFv XENP19818

SEQ ID NO: 28858 - protein, 12 aa, Artificial Sequence
  Description of Artificial Sequence: Synthetic peptide
  Fab XENP19280, scFv XENP19818 vlCDR1
RASQSVGSSYLA

SEQ ID NO: 28859 - protein, 7 aa, Artificial Sequence
  Description of Artificial Sequence: Synthetic peptide
  Fab XENP19280, scFv XENP19818 vlCDR2
GAFSRAT

SEQ ID NO: 28860 - protein, 9 aa, Artificial Sequence
  Description of Artificial Sequence: Synthetic peptide
  Fab XENP19280, scFv XENP19818 vlCDR3
QQYGSSPWT

SEQ ID NO: 28861 - protein, 246 aa, Artificial Sequence; identical to SEQ ID NO: 5489
  Description of Artificial Sequence: Synthetic polypeptide
  Fab XENP19280, scFv XENP19818 scFv

SEQ ID NO: 28862 - protein, 118 aa, Artificial Sequence; identical to SEQ ID NO: 3737
  Description of Artificial Sequence: Synthetic polypeptide
  VH of Fab XENP19437, scFv XENP19910

SEQ ID NO: 28863 - protein, 5 aa, Artificial Sequence
  Description of Artificial Sequence: Synthetic peptide
  Fab XENP19437, scFv XENP19910 vhCDR1
SYTMH

SEQ ID NO: 28864 - protein, 17 aa, Artificial Sequence
  Description of Artificial Sequence: Synthetic peptide
  Fab XENP19437, scFv XENP19910 vhCDR2
FISYDGNNKYYADSVKG

SEQ ID NO: 28865 - protein, 9 aa, Artificial Sequence
  Description of Artificial Sequence: Synthetic peptide
  Fab XENP19437, scFv XENP19910 vhCDR3
TGWLGPFDY

SEQ ID NO: 28866 - protein, 20 aa, Artificial Sequence
  Description of Artificial Sequence: Synthetic peptide
  Fab XENP19437, scFv XENP19910 scFv linker
GKPGSGKPGSGKPGSGKPGS

SEQ ID NO: 28867 - protein, 108 aa, Artificial Sequence; identical to SEQ ID NO: 2411
  Description of Artificial Sequence: Synthetic polypeptide
  VL of Fab XENP19437, scFv XENP19910

SEQ ID NO: 28868 - protein, 12 aa, Artificial Sequence
  Description of Artificial Sequence: Synthetic peptide
  Fab XENP19437, scFv XENP19910 vlCDR1
RASQSVSSSYLA

SEQ ID NO: 28869 - protein, 7 aa, Artificial Sequence
  Description of Artificial Sequence: Synthetic peptide
  Fab XENP19437, scFv XENP19910 vlCDR2
GAFSRAT

SEQ ID NO: 28870 - protein, 9 aa, Artificial Sequence
  Description of Artificial Sequence: Synthetic peptide
  Fab XENP19437, scFv XENP19910 vlCDR3
QQYGSSPWT

SEQ ID NO: 28871 - protein, 246 aa, Artificial Sequence; identical to SEQ ID NO: 6281
  Description of Artificial Sequence: Synthetic polypeptide
  Fab XENP19437, scFv XENP19910 scFv

SEQ ID NO: 28872 - protein, 118 aa, Artificial Sequence; identical to SEQ ID NO: 4806
  Description of Artificial Sequence: Synthetic polypeptide
  VH of Fab XENP19545, scFv XENP19552

SEQ ID NO: 28873 - protein, 5 aa, Artificial Sequence
  Description of Artificial Sequence: Synthetic peptide
  Fab XENP19545, scFv XENP19552 vhCDR1
SYTMH

SEQ ID NO: 28874 - protein, 17 aa, Artificial Sequence
  Description of Artificial Sequence: Synthetic peptide
  Fab XENP19545, scFv XENP19552 vhCDR2
FISYDGNNKYYPGSVKG

SEQ ID NO: 28875 - protein, 9 aa, Artificial Sequence
  Description of Artificial Sequence: Synthetic peptide
  Fab XENP19545, scFv XENP19552 vhCDR3
TGWLGPFDY

SEQ ID NO: 28876 - protein, 20 aa, Artificial Sequence
  Description of Artificial Sequence: Synthetic peptide
  Fab XENP19545, scFv XENP19552 scFv linker
GKPGSGKPGSGKPGSGKPGS

SEQ ID NO: 28877 - protein, 108 aa, Artificial Sequence; identical to SEQ ID NO: 3741
  Description of Artificial Sequence: Synthetic polypeptide
  VL of Fab XENP19545, scFv XENP19552

SEQ ID NO: 28878 - protein, 12 aa, Artificial Sequence
  Description of Artificial Sequence: Synthetic peptide
  Fab XENP19545, scFv XENP19552 vlCDR1
RASQSVGSSYLA

SEQ ID NO: 28879 - protein, 7 aa, Artificial Sequence
  Description of Artificial Sequence: Synthetic peptide
  Fab XENP19545, scFv XENP19552 vlCDR2
GAFSRAT

SEQ ID NO: 28880 - protein, 9 aa, Artificial Sequence
  Description of Artificial Sequence: Synthetic peptide
  Fab XENP19545, scFv XENP19552 vlCDR3
QQYGSSPWT

SEQ ID NO: 28881 - protein, 246 aa, Artificial Sequence; identical to SEQ ID NO: 4805
  Description of Artificial Sequence: Synthetic polypeptide
  Fab XENP19545, scFv XENP19552 scFv

SEQ ID NO: 28882 - protein, 118 aa, Artificial Sequence; identical to SEQ ID NO: 7290
  Description of Artificial Sequence: Synthetic polypeptide
  VH of Fab XENP20422, scFv XENP20431

SEQ ID NO: 28883 - protein, 5 aa, Artificial Sequence
  Description of Artificial Sequence: Synthetic peptide
  Fab XENP20422, scFv XENP20431 vhCDR1
SYTMH

SEQ ID NO: 28884 - protein, 17 aa, Artificial Sequence
  Description of Artificial Sequence: Synthetic peptide
  Fab XENP20422, scFv XENP20431 vhCDR2
FISYDGNTKYYADSVKG

SEQ ID NO: 28885 - protein, 9 aa, Artificial Sequence
  Description of Artificial Sequence: Synthetic peptide
  Fab XENP20422, scFv XENP20431 vhCDR3
GGLLGPFDL

SEQ ID NO: 28886 - protein, 20 aa, Artificial Sequence
  Description of Artificial Sequence: Synthetic peptide
  Fab XENP20422, scFv XENP20431 scFv linker
GKPGSGKPGSGKPGSGKPGS

SEQ ID NO: 28887 - protein, 108 aa, Artificial Sequence; identical to SEQ ID NO: 7399
  Description of Artificial Sequence: Synthetic polypeptide
  VL of Fab XENP20422, scFv XENP20431

SEQ ID NO: 28888 - protein, 12 aa, Artificial Sequence
  Description of Artificial Sequence: Synthetic peptide
  Fab XENP20422, scFv XENP20431 vlCDR1
RASQSVGSSYLA

SEQ ID NO: 28889 - protein, 7 aa, Artificial Sequence
  Description of Artificial Sequence: Synthetic peptide
  Fab XENP20422, scFv XENP20431 vlCDR2
GASSRAT

SEQ ID NO: 28890 - protein, 9 aa, Artificial Sequence
  Description of Artificial Sequence: Synthetic peptide
  Fab XENP20422, scFv XENP20431 vlCDR3
QQYGSSPWT

SEQ ID NO: 28891 - protein, 246 aa, Artificial Sequence; identical to SEQ ID NO: 7514
  Description of Artificial Sequence: Synthetic polypeptide
  Fab XENP20422, scFv XENP20431 scFv

SEQ ID NO: 28892 - protein, 118 aa, Artificial Sequence; identical to SEQ ID NO: 7290
  Description of Artificial Sequence: Synthetic polypeptide
  VH of Fab XENP20423, scFv XENP20432

SEQ ID NO: 28893 - protein, 5 aa, Artificial Sequence
  Description of Artificial Sequence: Synthetic peptide
  Fab XENP20423, scFv XENP20432 vhCDR1
SYTMH

SEQ ID NO: 28894 - protein, 17 aa, Artificial Sequence
  Description of Artificial Sequence: Synthetic peptide
  Fab XENP20423, scFv XENP20432 vhCDR2
FISYDGNTKYYADSVKG

SEQ ID NO: 28895 - protein, 9 aa, Artificial Sequence
  Description of Artificial Sequence: Synthetic peptide
  Fab XENP20423, scFv XENP20432 vhCDR3
GGLLGPFDL

SEQ ID NO: 28896 - protein, 20 aa, Artificial Sequence
  Description of Artificial Sequence: Synthetic peptide
  Fab XENP20423, scFv XENP20432 scFv linker
GKPGSGKPGSGKPGSGKPGS

SEQ ID NO: 28897 - protein, 108 aa, Artificial Sequence; identical to SEQ ID NO: 2396
  Description of Artificial Sequence: Synthetic polypeptide
  VL of Fab XENP20423, scFv XENP20432

SEQ ID NO: 28898 - protein, 12 aa, Artificial Sequence
  Description of Artificial Sequence: Synthetic peptide
  Fab XENP20423, scFv XENP20432 vlCDR1
RASQSVGSSYLA

SEQ ID NO: 28899 - protein, 7 aa, Artificial Sequence
  Description of Artificial Sequence: Synthetic peptide
  Fab XENP20423, scFv XENP20432 vlCDR2
GASSRAT

SEQ ID NO: 28900 - protein, 9 aa, Artificial Sequence
  Description of Artificial Sequence: Synthetic peptide
  Fab XENP20423, scFv XENP20432 vlCDR3
QQYGSSPWT

SEQ ID NO: 28901 - protein, 246 aa, Artificial Sequence; identical to SEQ ID NO: 7523
  Description of Artificial Sequence: Synthetic polypeptide
  Fab XENP20423, scFv XENP20432 scFv

SEQ ID NO: 28902 - protein, 118 aa, Artificial Sequence; identical to SEQ ID NO: 7290
  Description of Artificial Sequence: Synthetic polypeptide
  VH of Fab XENP20424, scFv XENP20433

SEQ ID NO: 28903 - protein, 5 aa, Artificial Sequence
  Description of Artificial Sequence: Synthetic peptide
  Fab XENP20424, scFv XENP20433 vhCDR1
SYTMH

SEQ ID NO: 28904 - protein, 17 aa, Artificial Sequence
  Description of Artificial Sequence: Synthetic peptide
  Fab XENP20424, scFv XENP20433 vhCDR2
FISYDGNTKYYADSVKG

SEQ ID NO: 28905 - protein, 9 aa, Artificial Sequence
  Description of Artificial Sequence: Synthetic peptide
  Fab XENP20424, scFv XENP20433 vhCDR3
GGLLGPFDL

SEQ ID NO: 28906 - protein, 20 aa, Artificial Sequence
  Description of Artificial Sequence: Synthetic peptide
  Fab XENP20424, scFv XENP20433 scFv linker
GKPGSGKPGSGKPGSGKPGS

SEQ ID NO: 28907 - protein, 108 aa, Artificial Sequence; identical to SEQ ID NO: 7471
  Description of Artificial Sequence: Synthetic polypeptide
  VL of Fab XENP20424, scFv XENP20433

SEQ ID NO: 28908 - protein, 12 aa, Artificial Sequence
  Description of Artificial Sequence: Synthetic peptide
  Fab XENP20424, scFv XENP20433 vlCDR1
RASQSVSSSYLA

SEQ ID NO: 28909 - protein, 7 aa, Artificial Sequence
  Description of Artificial Sequence: Synthetic peptide
  Fab XENP20424, scFv XENP20433 vlCDR2
GASSRAT

SEQ ID NO: 28910 - protein, 9 aa, Artificial Sequence
  Description of Artificial Sequence: Synthetic peptide
  Fab XENP20424, scFv XENP20433 vlCDR3
QQYGSSPWT

SEQ ID NO: 28911 - protein, 246 aa, Artificial Sequence; identical to SEQ ID NO: 7532
  Description of Artificial Sequence: Synthetic polypeptide
  Fab XENP20424, scFv XENP20433 scFv

SEQ ID NO: 28912 - protein, 118 aa, Artificial Sequence; identical to SEQ ID NO: 2395
  Description of Artificial Sequence: Synthetic polypeptide
  VH of Fab XENP20425, scFv XENP20434

SEQ ID NO: 28913 - protein, 5 aa, Artificial Sequence
  Description of Artificial Sequence: Synthetic peptide
  Fab XENP20425, scFv XENP20434 vhCDR1
SYTMH

SEQ ID NO: 28914 - protein, 17 aa, Artificial Sequence
  Description of Artificial Sequence: Synthetic peptide
  Fab XENP20425, scFv XENP20434 vhCDR2
FISYDGNYKYYADSVKG

SEQ ID NO: 28915 - protein, 9 aa, Artificial Sequence
  Description of Artificial Sequence: Synthetic peptide
  Fab XENP20425, scFv XENP20434 vhCDR3
GGHLGPFDL

SEQ ID NO: 28916 - protein, 20 aa, Artificial Sequence
  Description of Artificial Sequence: Synthetic peptide
  Fab XENP20425, scFv XENP20434 scFv linker
GKPGSGKPGSGKPGSGKPGS

SEQ ID NO: 28917 - protein, 108 aa, Artificial Sequence; identical to SEQ ID NO: 7399
  Description of Artificial Sequence: Synthetic polypeptide
  VL of Fab XENP20425, scFv XENP20434

SEQ ID NO: 28918 - protein, 12 aa, Artificial Sequence
  Description of Artificial Sequence: Synthetic peptide
  Fab XENP20425, scFv XENP20434 vlCDR1
RASQSVGSSYLA

SEQ ID NO: 28919 - protein, 7 aa, Artificial Sequence
  Description of Artificial Sequence: Synthetic peptide
  Fab XENP20425, scFv XENP20434 vlCDR2
GASSRAT

SEQ ID NO: 28920 - protein, 9 aa, Artificial Sequence
  Description of Artificial Sequence: Synthetic peptide
  Fab XENP20425, scFv XENP20434 vlCDR3
QQYGSSPWT

SEQ ID NO: 28921 - protein, 246 aa, Artificial Sequence; identical to SEQ ID NO: 7541
  Description of Artificial Sequence: Synthetic polypeptide
  Fab XENP20425, scFv XENP20434 scFv

SEQ ID NO: 28922 - protein, 118 aa, Artificial Sequence; identical to SEQ ID NO: 2395
  Description of Artificial Sequence: Synthetic polypeptide
  VH of Fab XENP20426, scFv XENP20435

SEQ ID NO: 28923 - protein, 5 aa, Artificial Sequence
  Description of Artificial Sequence: Synthetic peptide
  Fab XENP20426, scFv XENP20435 vhCDR1
SYTMH

SEQ ID NO: 28924 - protein, 17 aa, Artificial Sequence
  Description of Artificial Sequence: Synthetic peptide
  Fab XENP20426, scFv XENP20435 vhCDR2
FISYDGNYKYYADSVKG

SEQ ID NO: 28925 - protein, 9 aa, Artificial Sequence
  Description of Artificial Sequence: Synthetic peptide
  Fab XENP20426, scFv XENP20435 vhCDR3
GGHLGPFDL

SEQ ID NO: 28926 - protein, 20 aa, Artificial Sequence
  Description of Artificial Sequence: Synthetic peptide
  Fab XENP20426, scFv XENP20435 scFv linker
GKPGSGKPGSGKPGSGKPGS

SEQ ID NO: 28927 - protein, 108 aa, Artificial Sequence; identical to SEQ ID NO: 2396
  Description of Artificial Sequence: Synthetic polypeptide
  VL of Fab XENP20426, scFv XENP20435

SEQ ID NO: 28928 - protein, 12 aa, Artificial Sequence
  Description of Artificial Sequence: Synthetic peptide
  Fab XENP20426, scFv XENP20435 vlCDR1
RASQSVGSSYLA

SEQ ID NO: 28929 - protein, 7 aa, Artificial Sequence
  Description of Artificial Sequence: Synthetic peptide
  Fab XENP20426, scFv XENP20435 vlCDR2
GASSRAT

SEQ ID NO: 28930 - protein, 9 aa, Artificial Sequence
  Description of Artificial Sequence: Synthetic peptide
  Fab XENP20426, scFv XENP20435 vlCDR3
QQYGSSPWT

SEQ ID NO: 28931 - protein, 246 aa, Artificial Sequence; identical to SEQ ID NO: 7550
  Description of Artificial Sequence: Synthetic polypeptide
  Fab XENP20426, scFv XENP20435 scFv

SEQ ID NO: 28932 - protein, 118 aa, Artificial Sequence; identical to SEQ ID NO: 2395
  Description of Artificial Sequence: Synthetic polypeptide
  VH of Fab XENP20427, scFv XENP20436

SEQ ID NO: 28933 - protein, 5 aa, Artificial Sequence
  Description of Artificial Sequence: Synthetic peptide
  Fab XENP20427, scFv XENP20436 vhCDR1
SYTMH

SEQ ID NO: 28934 - protein, 17 aa, Artificial Sequence
  Description of Artificial Sequence: Synthetic peptide
  Fab XENP20427, scFv XENP20436 vhCDR2
FISYDGNYKYYADSVKG

SEQ ID NO: 28935 - protein, 9 aa, Artificial Sequence
  Description of Artificial Sequence: Synthetic peptide
  Fab XENP20427, scFv XENP20436 vhCDR3
GGHLGPFDL

SEQ ID NO: 28936 - protein, 20 aa, Artificial Sequence
  Description of Artificial Sequence: Synthetic peptide
  Fab XENP20427, scFv XENP20436 scFv linker
GKPGSGKPGSGKPGSGKPGS

SEQ ID NO: 28937 - protein, 108 aa, Artificial Sequence; identical to SEQ ID NO: 7471
  Description of Artificial Sequence: Synthetic polypeptide
  VL of Fab XENP20427, scFv XENP20436

SEQ ID NO: 28938 - protein, 12 aa, Artificial Sequence
  Description of Artificial Sequence: Synthetic peptide
  Fab XENP20427, scFv XENP20436 vlCDR1
RASQSVSSSYLA

SEQ ID NO: 28939 - protein, 7 aa, Artificial Sequence
  Description of Artificial Sequence: Synthetic peptide
  Fab XENP20427, scFv XENP20436 vlCDR2
GASSRAT

SEQ ID NO: 28940 - protein, 9 aa, Artificial Sequence
  Description of Artificial Sequence: Synthetic peptide
  Fab XENP20427, scFv XENP20436 vlCDR3
QQYGSSPWT

SEQ ID NO: 28941 - protein, 246 aa, Artificial Sequence; identical to SEQ ID NO: 7559
  Description of Artificial Sequence: Synthetic polypeptide
  Fab XENP20427, scFv XENP20436 scFv

SEQ ID NO: 28942 - protein, 118 aa, Artificial Sequence; identical to SEQ ID NO: 7326
  Description of Artificial Sequence: Synthetic polypeptide
  VH of Fab XENP20428, scFv XENP20437

SEQ ID NO: 28943 - protein, 5 aa, Artificial Sequence
  Description of Artificial Sequence: Synthetic peptide
  Fab XENP20428, scFv XENP20437 vhCDR1
SYTMH

SEQ ID NO: 28944 - protein, 17 aa, Artificial Sequence
  Description of Artificial Sequence: Synthetic peptide
  Fab XENP20428, scFv XENP20437 vhCDR2
FISYDGNYKYYADSVKG

SEQ ID NO: 28945 - protein, 9 aa, Artificial Sequence
  Description of Artificial Sequence: Synthetic peptide
  Fab XENP20428, scFv XENP20437 vhCDR3
GGLLGPFDL

SEQ ID NO: 28946 - protein, 20 aa, Artificial Sequence
  Description of Artificial Sequence: Synthetic peptide
  Fab XENP20428, scFv XENP20437 scFv linker
GKPGSGKPGSGKPGSGKPGS

SEQ ID NO: 28947 - protein, 108 aa, Artificial Sequence; identical to SEQ ID NO: 7399
  Description of Artificial Sequence: Synthetic polypeptide
  VL of Fab XENP20428, scFv XENP20437

SEQ ID NO: 28948 - protein, 12 aa, Artificial Sequence
  Description of Artificial Sequence: Synthetic peptide
  Fab XENP20428, scFv XENP20437 vlCDR1
RASQSVGSSYLA

SEQ ID NO: 28949 - protein, 7 aa, Artificial Sequence
  Description of Artificial Sequence: Synthetic peptide
  Fab XENP20428, scFv XENP20437 vlCDR2
GASSRAT

SEQ ID NO: 28950 - protein, 9 aa, Artificial Sequence
  Description of Artificial Sequence: Synthetic peptide
  Fab XENP20428, scFv XENP20437 vlCDR3
QQYGSSPWT

SEQ ID NO: 28951 - protein, 246 aa, Artificial Sequence; identical to SEQ ID NO: 7568
  Description of Artificial Sequence: Synthetic polypeptide
  Fab XENP20428, scFv XENP20437 scFv

SEQ ID NO: 28952 - protein, 118 aa, Artificial Sequence; identical to SEQ ID NO: 7326
  Description of Artificial Sequence: Synthetic polypeptide
  VH of Fab XENP20429, scFv XENP20438

SEQ ID NO: 28953 - protein, 5 aa, Artificial Sequence
  Description of Artificial Sequence: Synthetic peptide
  Fab XENP20429, scFv XENP20438 vhCDR1
SYTMH

SEQ ID NO: 28954 - protein, 17 aa, Artificial Sequence
  Description of Artificial Sequence: Synthetic peptide
  Fab XENP20429, scFv XENP20438 vhCDR2
FISYDGNYKYYADSVKG

SEQ ID NO: 28955 - protein, 9 aa, Artificial Sequence
  Description of Artificial Sequence: Synthetic peptide
  Fab XENP20429, scFv XENP20438 vhCDR3
GGLLGPFDL

SEQ ID NO: 28956 - protein, 20 aa, Artificial Sequence
  Description of Artificial Sequence: Synthetic peptide
  Fab XENP20429, scFv XENP20438 scFv linker
GKPGSGKPGSGKPGSGKPGS

SEQ ID NO: 28957 - protein, 108 aa, Artificial Sequence; identical to SEQ ID NO: 2396
  Description of Artificial Sequence: Synthetic polypeptide
  VL of Fab XENP20429, scFv XENP20438

SEQ ID NO: 28958 - protein, 12 aa, Artificial Sequence
  Description of Artificial Sequence: Synthetic peptide
  Fab XENP20429, scFv XENP20438 vlCDR1
RASQSVGSSYLA

SEQ ID NO: 28959 - protein, 7 aa, Artificial Sequence
  Description of Artificial Sequence: Synthetic peptide
  Fab XENP20429, scFv XENP20438 vlCDR2
GASSRAT

SEQ ID NO: 28960 - protein, 9 aa, Artificial Sequence
  Description of Artificial Sequence: Synthetic peptide
  Fab XENP20429, scFv XENP20438 vlCDR3
QQYGSSPWT

SEQ ID NO: 28961 - protein, 246 aa, Artificial Sequence; identical to SEQ ID NO: 7577
  Description of Artificial Sequence: Synthetic polypeptide
  Fab XENP20429, scFv XENP20438 scFv

SEQ ID NO: 28962 - protein, 118 aa, Artificial Sequence; identical to SEQ ID NO: 7326
  Description of Artificial Sequence: Synthetic polypeptide
  VH of Fab XENP20430, scFv XENP20439

SEQ ID NO: 28963 - protein, 5 aa, Artificial Sequence
  Description of Artificial Sequence: Synthetic peptide
  Fab XENP20430, scFv XENP20439 vhCDR1
SYTMH

SEQ ID NO: 28964 - protein, 17 aa, Artificial Sequence
  Description of Artificial Sequence: Synthetic peptide
  Fab XENP20430, scFv XENP20439 vhCDR2
FISYDGNYKYYADSVKG

SEQ ID NO: 28965 - protein, 9 aa, Artificial Sequence
  Description of Artificial Sequence: Synthetic peptide
  Fab XENP20430, scFv XENP20439 vhCDR3
GGLLGPFDL

SEQ ID NO: 28966 - protein, 20 aa, Artificial Sequence
  Description of Artificial Sequence: Synthetic peptide
  Fab XENP20430, scFv XENP20439 scFv linker
GKPGSGKPGSGKPGSGKPGS

SEQ ID NO: 28967 - protein, 108 aa, Artificial Sequence; identical to SEQ ID NO: 7471
  Description of Artificial Sequence: Synthetic polypeptide
  VL of Fab XENP20430, scFv XENP20439

SEQ ID NO: 28968 - protein, 12 aa, Artificial Sequence
  Description of Artificial Sequence: Synthetic peptide
  Fab XENP20430, scFv XENP20439 vlCDR1
RASQSVSSSYLA

SEQ ID NO: 28969 - protein, 7 aa, Artificial Sequence
  Description of Artificial Sequence: Synthetic peptide
  Fab XENP20430, scFv XENP20439 vlCDR2
GASSRAT

SEQ ID NO: 28970 - protein, 9 aa, Artificial Sequence
  Description of Artificial Sequence: Synthetic peptide
  Fab XENP20430, scFv XENP20439 vlCDR3
QQYGSSPWT

SEQ ID NO: 28971 - protein, 246 aa, Artificial Sequence; identical to SEQ ID NO: 7586
  Description of Artificial Sequence: Synthetic polypeptide
  Fab XENP20430, scFv XENP20439 scFv

SEQ ID NO: 28972 - protein, 118 aa, Artificial Sequence; identical to SEQ ID NO: 7137
  Description of Artificial Sequence: Synthetic polypeptide
  VH of Fab XENP20341, scFv XENP20378

SEQ ID NO: 28973 - protein, 6 aa, Artificial Sequence
  Description of Artificial Sequence: Synthetic peptide
  Fab XENP20341, scFv XENP20378 vhCDR1
SSYTMH

SEQ ID NO: 28974 - protein, 17 aa, Artificial Sequence
  Description of Artificial Sequence: Synthetic peptide
  Fab XENP20341, scFv XENP20378 vhCDR2
FISYDGNHKYYADSVKG

SEQ ID NO: 28975 - protein, 9 aa, Artificial Sequence
  Description of Artificial Sequence: Synthetic peptide
  Fab XENP20341, scFv XENP20378 vhCDR3
TGHLGPFDL

SEQ ID NO: 28976 - protein, 20 aa, Artificial Sequence
  Description of Artificial Sequence: Synthetic peptide
  Fab XENP20341, scFv XENP20378 scFv linker
GKPGSGKPGSGKPGSGKPGS

SEQ ID NO: 28977 - protein, 108 aa, Artificial Sequence; identical to SEQ ID NO: 7345
  Description of Artificial Sequence: Synthetic polypeptide
  VL of Fab XENP20341, scFv XENP20378

SEQ ID NO: 28978 - protein, 12 aa, Artificial Sequence
  Description of Artificial Sequence: Synthetic peptide
  Fab XENP20341, scFv XENP20378 vlCDR1
RASQSVGSSYLA

SEQ ID NO: 28979 - protein, 7 aa, Artificial Sequence
  Description of Artificial Sequence: Synthetic peptide
  Fab XENP20341, scFv XENP20378 vlCDR2
GAFSRAT

SEQ ID NO: 28980 - protein, 9 aa, Artificial Sequence
  Description of Artificial Sequence: Synthetic peptide
  Fab XENP20341, scFv XENP20378 vlCDR3
QQYGSSPWT

SEQ ID NO: 28981 - protein, 246 aa, Artificial Sequence; identical to SEQ ID NO: 7343
  Description of Artificial Sequence: Synthetic polypeptide
  Fab XENP20341, scFv XENP20378 scFv

SEQ ID NO: 28982 - protein, 118 aa, Artificial Sequence; identical to SEQ ID NO: 7137
  Description of Artificial Sequence: Synthetic polypeptide
  VH of Fab XENP20342, scFv XENP20379

SEQ ID NO: 28983 - protein, 5 aa, Artificial Sequence
  Description of Artificial Sequence: Synthetic peptide
  Fab XENP20342, scFv XENP20379 vhCDR1
SYTMH

SEQ ID NO: 28984 - protein, 17 aa, Artificial Sequence
  Description of Artificial Sequence: Synthetic peptide
  Fab XENP20342, scFv XENP20379 vhCDR2
FISYDGNHKYYADSVKG

SEQ ID NO: 28985 - protein, 9 aa, Artificial Sequence
  Description of Artificial Sequence: Synthetic peptide
  Fab XENP20342, scFv XENP20379 vhCDR3
TGHLGPFDL

SEQ ID NO: 28986 - protein, 20 aa, Artificial Sequence
  Description of Artificial Sequence: Synthetic peptide
  Fab XENP20342, scFv XENP20379 scFv linker
GKPGSGKPGSGKPGSGKPGS

SEQ ID NO: 28987 - protein, 108 aa, Artificial Sequence; identical to SEQ ID NO: 3741
  Description of Artificial Sequence: Synthetic polypeptide
  VL of Fab XENP20342, scFv XENP20379

SEQ ID NO: 28988 - protein, 12 aa, Artificial Sequence
  Description of Artificial Sequence: Synthetic peptide
  Fab XENP20342, scFv XENP20379 vlCDR1
RASQSVGSSYLA

SEQ ID NO: 28989 - protein, 7 aa, Artificial Sequence
  Description of Artificial Sequence: Synthetic peptide
  Fab XENP20342, scFv XENP20379 vlCDR2
GAFSRAT

SEQ ID NO: 28990 - protein, 9 aa, Artificial Sequence
  Description of Artificial Sequence: Synthetic peptide
  Fab XENP20342, scFv XENP20379 vlCDR3
QQYGSSPWT

SEQ ID NO: 28991 - protein, 246 aa, Artificial Sequence; identical to SEQ ID NO: 7352
  Description of Artificial Sequence: Synthetic polypeptide
  Fab XENP20342, scFv XENP20379 scFv

SEQ ID NO: 28992 - protein, 118 aa, Artificial Sequence; identical to SEQ ID NO: 7137
  Description of Artificial Sequence: Synthetic polypeptide
  VH of Fab XENP20071, scFv XENP20078

SEQ ID NO: 28993 - protein, 5 aa, Artificial Sequence
  Description of Artificial Sequence: Synthetic peptide
  Fab XENP20071, scFv XENP20078 vhCDR1
SYTMH

SEQ ID NO: 28994 - protein, 17 aa, Artificial Sequence
  Description of Artificial Sequence: Synthetic peptide
  Fab XENP20071, scFv XENP20078 vhCDR2
FISYDGNHKYYADSVKG

SEQ ID NO: 28995 - protein, 9 aa, Artificial Sequence
  Description of Artificial Sequence: Synthetic peptide
  Fab XENP20071, scFv XENP20078 vhCDR3
TGHLGPFDL

SEQ ID NO: 28996 - protein, 20 aa, Artificial Sequence
  Description of Artificial Sequence: Synthetic peptide
  Fab XENP20071, scFv XENP20078 scFv linker
GKPGSGKPGSGKPGSGKPGS

SEQ ID NO: 28997 - protein, 108 aa, Artificial Sequence; identical to SEQ ID NO: 6193
  Description of Artificial Sequence: Synthetic polypeptide
  VL of Fab XENP20071, scFv XENP20078

SEQ ID NO: 28998 - protein, 12 aa, Artificial Sequence
  Description of Artificial Sequence: Synthetic peptide
  Fab XENP20071, scFv XENP20078 vlCDR1
RASQSVGSSYLA

SEQ ID NO: 28999 - protein, 7 aa, Artificial Sequence
  Description of Artificial Sequence: Synthetic peptide
  Fab XENP20071, scFv XENP20078 vlCDR2
GAFSRAT

SEQ ID NO: 29000 - protein, 9 aa, Artificial Sequence
  Description of Artificial Sequence: Synthetic peptide
  Fab XENP20071, scFv XENP20078 vlCDR3
QQYGSSPWT

SEQ ID NO: 29001 - protein, 246 aa, Artificial Sequence; identical to SEQ ID NO: 7136
  Description of Artificial Sequence: Synthetic polypeptide
  Fab XENP20071, scFv XENP20078 scFv

SEQ ID NO: 29002 - protein, 118 aa, Artificial Sequence; identical to SEQ ID NO: 7137
  Description of Artificial Sequence: Synthetic polypeptide
  VH of Fab XENP20344, scFv XENP20381

SEQ ID NO: 29003 - protein, 5 aa, Artificial Sequence
  Description of Artificial Sequence: Synthetic peptide
  Fab XENP20344, scFv XENP20381 vhCDR1
SYTMH

SEQ ID NO: 29004 - protein, 17 aa, Artificial Sequence
  Description of Artificial Sequence: Synthetic peptide
  Fab XENP20344, scFv XENP20381 vhCDR2
FISYDGNHKYYADSVKG

SEQ ID NO: 29005 - protein, 9 aa, Artificial Sequence
  Description of Artificial Sequence: Synthetic peptide
  Fab XENP20344, scFv XENP20381 vhCDR3
TGHLGPFDL

SEQ ID NO: 29006 - protein, 20 aa, Artificial Sequence
  Description of Artificial Sequence: Synthetic peptide
  Fab XENP20344, scFv XENP20381 scFv linker
GKPGSGKPGSGKPGSGKPGS

SEQ ID NO: 29007 - protein, 108 aa, Artificial Sequence; identical to SEQ ID NO: 7372
  Description of Artificial Sequence: Synthetic polypeptide
  VL of Fab XENP20344, scFv XENP20381

SEQ ID NO: 29008 - protein, 12 aa, Artificial Sequence
  Description of Artificial Sequence: Synthetic peptide
  Fab XENP20344, scFv XENP20381 vlCDR1
RASQSVGSSYLA

SEQ ID NO: 29009 - protein, 7 aa, Artificial Sequence
  Description of Artificial Sequence: Synthetic peptide
  Fab XENP20344, scFv XENP20381 vlCDR2
GASSRAT

SEQ ID NO: 29010 - protein, 9 aa, Artificial Sequence
  Description of Artificial Sequence: Synthetic peptide
  Fab XENP20344, scFv XENP20381 vlCDR3
QQYGSSPWT

SEQ ID NO: 29011 - protein, 246 aa, Artificial Sequence; identical to SEQ ID NO: 7370
  Description of Artificial Sequence: Synthetic polypeptide
  Fab XENP20344, scFv XENP20381 scFv

SEQ ID NO: 29012 - protein, 118 aa, Artificial Sequence; identical to SEQ ID NO: 7137
  Description of Artificial Sequence: Synthetic polypeptide
  VH of Fab XENP20345, scFv XENP20382

SEQ ID NO: 29013 - protein, 5 aa, Artificial Sequence
  Description of Artificial Sequence: Synthetic peptide
  Fab XENP20345, scFv XENP20382 vhCDR1
SYTMH

SEQ ID NO: 29014 - protein, 17 aa, Artificial Sequence
  Description of Artificial Sequence: Synthetic peptide
  Fab XENP20345, scFv XENP20382 vhCDR2
FISYDGNHKYYADSVKG

SEQ ID NO: 29015 - protein, 9 aa, Artificial Sequence
  Description of Artificial Sequence: Synthetic peptide
  Fab XENP20345, scFv XENP20382 vhCDR3
TGHLGPFDL

SEQ ID NO: 29016 - protein, 20 aa, Artificial Sequence
  Description of Artificial Sequence: Synthetic peptide
  Fab XENP20345, scFv XENP20382 scFv linker
GKPGSGKPGSGKPGSGKPGS

SEQ ID NO: 29017 - protein, 108 aa, Artificial Sequence; identical to SEQ ID NO: 6157
  Description of Artificial Sequence: Synthetic polypeptide
  VL of Fab XENP20345, scFv XENP20382

SEQ ID NO: 29018 - protein, 12 aa, Artificial Sequence
  Description of Artificial Sequence: Synthetic peptide
  Fab XENP20345, scFv XENP20382 vlCDR1
RASQSVGSSYLA

SEQ ID NO: 29019 - protein, 7 aa, Artificial Sequence
  Description of Artificial Sequence: Synthetic peptide
  Fab XENP20345, scFv XENP20382 vlCDR2
GAFSRAT

SEQ ID NO: 29020 - protein, 9 aa, Artificial Sequence
  Description of Artificial Sequence: Synthetic peptide
  Fab XENP20345, scFv XENP20382 vlCDR3
QQYGSSPWT

SEQ ID NO: 29021 - protein, 246 aa, Artificial Sequence; identical to SEQ ID NO: 7379
  Description of Artificial Sequence: Synthetic polypeptide
  Fab XENP20345, scFv XENP20382 scFv

SEQ ID NO: 29022 - protein, 118 aa, Artificial Sequence; identical to SEQ ID NO: 7137
  Description of Artificial Sequence: Synthetic polypeptide
  VH of Fab XENP20346, scFv XENP20383

SEQ ID NO: 29023 - protein, 5 aa, Artificial Sequence
  Description of Artificial Sequence: Synthetic peptide
  Fab XENP20346, scFv XENP20383 vhCDR1
SYTMH

SEQ ID NO: 29024 - protein, 17 aa, Artificial Sequence
  Description of Artificial Sequence: Synthetic peptide
  Fab XENP20346, scFv XENP20383 vhCDR2
FISYDGNHKYYADSVKG

SEQ ID NO: 29025 - protein, 9 aa, Artificial Sequence
  Description of Artificial Sequence: Synthetic peptide
  Fab XENP20346, scFv XENP20383 vhCDR3
TGHLGPFDL

SEQ ID NO: 29026 - protein, 20 aa, Artificial Sequence
  Description of Artificial Sequence: Synthetic peptide
  Fab XENP20346, scFv XENP20383 scFv linker
GKPGSGKPGSGKPGSGKPGS

SEQ ID NO: 29027 - protein, 108 aa, Artificial Sequence; identical to SEQ ID NO: 7390
  Description of Artificial Sequence: Synthetic polypeptide
  VL of Fab XENP20346, scFv XENP20383

SEQ ID NO: 29028 - protein, 12 aa, Artificial Sequence
  Description of Artificial Sequence: Synthetic peptide
  Fab XENP20346, scFv XENP20383 vlCDR1
RASQSVSSSYLA

SEQ ID NO: 29029 - protein, 7 aa, Artificial Sequence
  Description of Artificial Sequence: Synthetic peptide
  Fab XENP20346, scFv XENP20383 vlCDR2
GAFSRAT

SEQ ID NO: 29030 - protein, 9 aa, Artificial Sequence
  Description of Artificial Sequence: Synthetic peptide
  Fab XENP20346, scFv XENP20383 vlCDR3
QQYGSSPWT

SEQ ID NO: 29031 - protein, 246 aa, Artificial Sequence; identical to SEQ ID NO: 7388
  Description of Artificial Sequence: Synthetic polypeptide
  Fab XENP20346, scFv XENP20383 scFv

SEQ ID NO: 29032 - protein, 118 aa, Artificial Sequence; identical to SEQ ID NO: 7137
  Description of Artificial Sequence: Synthetic polypeptide
  VH of Fab XENP20347, scFv XENP20384

SEQ ID NO: 29033 - protein, 5 aa, Artificial Sequence
  Description of Artificial Sequence: Synthetic peptide
  Fab XENP20347, scFv XENP20384 vhCDR1
SYTMH

SEQ ID NO: 29034 - protein, 17 aa, Artificial Sequence
  Description of Artificial Sequence: Synthetic peptide
  Fab XENP20347, scFv XENP20384 vhCDR2
FISYDGNHKYYADSVKG

SEQ ID NO: 29035 - protein, 9 aa, Artificial Sequence
  Description of Artificial Sequence: Synthetic peptide
  Fab XENP20347, scFv XENP20384 vhCDR3
TGHLGPFDL

SEQ ID NO: 29036 - protein, 20 aa, Artificial Sequence
  Description of Artificial Sequence: Synthetic peptide
  Fab XENP20347, scFv XENP20384 scFv linker
GKPGSGKPGSGKPGSGKPGS

SEQ ID NO: 29037 - protein, 108 aa, Artificial Sequence; identical to SEQ ID NO: 7399
  Description of Artificial Sequence: Synthetic polypeptide
  VL of Fab XENP20347, scFv XENP20384

SEQ ID NO: 29038 - protein, 12 aa, Artificial Sequence
  Description of Artificial Sequence: Synthetic peptide
  Fab XENP20347, scFv XENP20384 vlCDR1
RASQSVGSSYLA

SEQ ID NO: 29039 - protein, 7 aa, Artificial Sequence
  Description of Artificial Sequence: Synthetic peptide
  Fab XENP20347, scFv XENP20384 vlCDR2
GASSRAT

SEQ ID NO: 29040 - protein, 9 aa, Artificial Sequence
  Description of Artificial Sequence: Synthetic peptide
  Fab XENP20347, scFv XENP20384 vlCDR3
QQYGSSPWT

SEQ ID NO: 29041 - protein, 246 aa, Artificial Sequence; identical to SEQ ID NO: 7397
  Description of Artificial Sequence: Synthetic polypeptide
  Fab XENP20347, scFv XENP20384 scFv

SEQ ID NO: 29042 - protein, 118 aa, Artificial Sequence; identical to SEQ ID NO: 7137
  Description of Artificial Sequence: Synthetic polypeptide
  VH of Fab XENP20348, scFv XENP20385

SEQ ID NO: 29043 - protein, 5 aa, Artificial Sequence
  Description of Artificial Sequence: Synthetic peptide
  Fab XENP20348, scFv XENP20385 vhCDR1
SYTMH

SEQ ID NO: 29044 - protein, 17 aa, Artificial Sequence
  Description of Artificial Sequence: Synthetic peptide
  Fab XENP20348, scFv XENP20385 vhCDR2
FISYDGNHKYYADSVKG

SEQ ID NO: 29045 - protein, 9 aa, Artificial Sequence
  Description of Artificial Sequence: Synthetic peptide
  Fab XENP20348, scFv XENP20385 vhCDR3
TGHLGPFDL

SEQ ID NO: 29046 - protein, 20 aa, Artificial Sequence
  Description of Artificial Sequence: Synthetic peptide
  Fab XENP20348, scFv XENP20385 scFv linker
GKPGSGKPGSGKPGSGKPGS

SEQ ID NO: 29047 - protein, 108 aa, Artificial Sequence; identical to SEQ ID NO: 2411
  Description of Artificial Sequence: Synthetic polypeptide
  VL of Fab XENP20348, scFv XENP20385

SEQ ID NO: 29048 - protein, 12 aa, Artificial Sequence
  Description of Artificial Sequence: Synthetic peptide
  Fab XENP20348, scFv XENP20385 vlCDR1
RASQSVSSSYLA

SEQ ID NO: 29049 - protein, 7 aa, Artificial Sequence
  Description of Artificial Sequence: Synthetic peptide
  Fab XENP20348, scFv XENP20385 vlCDR2
GAFSRAT

SEQ ID NO: 29050 - protein, 9 aa, Artificial Sequence
  Description of Artificial Sequence: Synthetic peptide
  Fab XENP20348, scFv XENP20385 vlCDR3
QQYGSSPWT

SEQ ID NO: 29051 - protein, 246 aa, Artificial Sequence; identical to SEQ ID NO: 7406
  Description of Artificial Sequence: Synthetic polypeptide
  Fab XENP20348, scFv XENP20385 scFv

SEQ ID NO: 29052 - protein, 118 aa, Artificial Sequence; identical to SEQ ID NO: 7137
  Description of Artificial Sequence: Synthetic polypeptide
  VH of Fab XENP20349, scFv XENP20386

SEQ ID NO: 29053 - protein, 5 aa, Artificial Sequence
  Description of Artificial Sequence: Synthetic peptide
  Fab XENP20349, scFv XENP20386 vhCDR1
SYTMH

SEQ ID NO: 29054 - protein, 17 aa, Artificial Sequence
  Description of Artificial Sequence: Synthetic peptide
  Fab XENP20349, scFv XENP20386 vhCDR2
FISYDGNHKYYADSVKG

SEQ ID NO: 29055 - protein, 9 aa, Artificial Sequence
  Description of Artificial Sequence: Synthetic peptide
  Fab XENP20349, scFv XENP20386 vhCDR3
TGHLGPFDL

SEQ ID NO: 29056 - protein, 20 aa, Artificial Sequence
  Description of Artificial Sequence: Synthetic peptide
  Fab XENP20349, scFv XENP20386 scFv linker
GKPGSGKPGSGKPGSGKPGS

SEQ ID NO: 29057 - protein, 108 aa, Artificial Sequence; identical to SEQ ID NO: 6742
  Description of Artificial Sequence: Synthetic polypeptide
  VL of Fab XENP20349, scFv XENP20386

SEQ ID NO: 29058 - protein, 12 aa, Artificial Sequence
  Description of Artificial Sequence: Synthetic peptide
  Fab XENP20349, scFv XENP20386 vlCDR1
RASQSVGSSYLA

SEQ ID NO: 29059 - protein, 7 aa, Artificial Sequence
  Description of Artificial Sequence: Synthetic peptide
  Fab XENP20349, scFv XENP20386 vlCDR2
GASSRAT

SEQ ID NO: 29060 - protein, 9 aa, Artificial Sequence
  Description of Artificial Sequence: Synthetic peptide
  Fab XENP20349, scFv XENP20386 vlCDR3
QQYGSSPWT

SEQ ID NO: 29061 - protein, 246 aa, Artificial Sequence; identical to SEQ ID NO: 7415
  Description of Artificial Sequence: Synthetic polypeptide
  Fab XENP20349, scFv XENP20386 scFv

SEQ ID NO: 29062 - protein, 118 aa, Artificial Sequence; identical to SEQ ID NO: 7137
  Description of Artificial Sequence: Synthetic polypeptide
  VH of Fab XENP20350, scFv XENP20387

SEQ ID NO: 29063 - protein, 5 aa, Artificial Sequence
  Description of Artificial Sequence: Synthetic peptide
  Fab XENP20350, scFv XENP20387 vhCDR1
SYTMH

SEQ ID NO: 29064 - protein, 17 aa, Artificial Sequence
  Description of Artificial Sequence: Synthetic peptide
  Fab XENP20350, scFv XENP20387 vhCDR2
FISYDGNHKYYADSVKG

SEQ ID NO: 29065 - protein, 9 aa, Artificial Sequence
  Description of Artificial Sequence: Synthetic peptide
  Fab XENP20350, scFv XENP20387 vhCDR3
TGHLGPFDL

SEQ ID NO: 29066 - protein, 20 aa, Artificial Sequence
  Description of Artificial Sequence: Synthetic peptide
  Fab XENP20350, scFv XENP20387 scFv linker
GKPGSGKPGSGKPGSGKPGS

SEQ ID NO: 29067 - protein, 108 aa, Artificial Sequence; identical to SEQ ID NO: 7426
  Description of Artificial Sequence: Synthetic polypeptide
  VL of Fab XENP20350, scFv XENP20387

SEQ ID NO: 29068 - protein, 12 aa, Artificial Sequence
  Description of Artificial Sequence: Synthetic peptide
  Fab XENP20350, scFv XENP20387 vlCDR1
RASQSVSSSYLA

SEQ ID NO: 29069 - protein, 7 aa, Artificial Sequence
  Description of Artificial Sequence: Synthetic peptide
  Fab XENP20350, scFv XENP20387 vlCDR2
GASSRAT

SEQ ID NO: 29070 - protein, 9 aa, Artificial Sequence
  Description of Artificial Sequence: Synthetic peptide
  Fab XENP20350, scFv XENP20387 vlCDR3
QQYGSSPWT

SEQ ID NO: 29071 - protein, 246 aa, Artificial Sequence; identical to SEQ ID NO: 7424
  Description of Artificial Sequence: Synthetic polypeptide
  Fab XENP20350, scFv XENP20387 scFv

SEQ ID NO: 29072 - protein, 118 aa, Artificial Sequence; identical to SEQ ID NO: 7137
  Description of Artificial Sequence: Synthetic polypeptide
  VH of Fab XENP20351, scFv XENP20388

SEQ ID NO: 29073 - protein, 5 aa, Artificial Sequence
  Description of Artificial Sequence: Synthetic peptide
  Fab XENP20351, scFv XENP20388 vhCDR1
SYTMH

SEQ ID NO: 29074 - protein, 17 aa, Artificial Sequence
  Description of Artificial Sequence: Synthetic peptide
  Fab XENP20351, scFv XENP20388 vhCDR2
FISYDGNHKYYADSVKG

SEQ ID NO: 29075 - protein, 9 aa, Artificial Sequence
  Description of Artificial Sequence: Synthetic peptide
  Fab XENP20351, scFv XENP20388 vhCDR3
TGHLGPFDL

SEQ ID NO: 29076 - protein, 20 aa, Artificial Sequence
  Description of Artificial Sequence: Synthetic peptide
  Fab XENP20351, scFv XENP20388 scFv linker
GKPGSGKPGSGKPGSGKPGS

SEQ ID NO: 29077 - protein, 108 aa, Artificial Sequence; identical to SEQ ID NO: 7435
  Description of Artificial Sequence: Synthetic polypeptide
  VL of Fab XENP20351, scFv XENP20388

SEQ ID NO: 29078 - protein, 12 aa, Artificial Sequence
  Description of Artificial Sequence: Synthetic peptide
  Fab XENP20351, scFv XENP20388 vlCDR1
RASQSVSSSYLA

SEQ ID NO: 29079 - protein, 7 aa, Artificial Sequence
  Description of Artificial Sequence: Synthetic peptide
  Fab XENP20351, scFv XENP20388 vlCDR2
GAFSRAT

SEQ ID NO: 29080 - protein, 9 aa, Artificial Sequence
  Description of Artificial Sequence: Synthetic peptide
  Fab XENP20351, scFv XENP20388 vlCDR3
QQYGSSPWT

SEQ ID NO: 29081 - protein, 246 aa, Artificial Sequence; identical to SEQ ID NO: 7433
  Description of Artificial Sequence: Synthetic polypeptide
  Fab XENP20351, scFv XENP20388 scFv

SEQ ID NO: 29082 - protein, 20 aa, Artificial Sequence
  Description of Artificial Sequence: Synthetic peptide
  Fab XENP20352, scFv XENP20389 scFv linker
GKPGSGKPGSGKPGSGKPGS

SEQ ID NO: 29083 - protein, 118 aa, Artificial Sequence; identical to SEQ ID NO: 7137
  Description of Artificial Sequence: Synthetic polypeptide
  VL of Fab XENP20352, scFv XENP20389

SEQ ID NO: 29084 - protein, 5 aa, Artificial Sequence
  Description of Artificial Sequence: Synthetic peptide
  Fab XENP20352, scFv XENP20389 vlCDR1
SYTMH

SEQ ID NO: 29085 - protein, 17 aa, Artificial Sequence
  Description of Artificial Sequence: Synthetic peptide
  Fab XENP20352, scFv XENP20389 vlCDR2
FISYDGNHKYYADSVKG

SEQ ID NO: 29086 - protein, 9 aa, Artificial Sequence
  Description of Artificial Sequence: Synthetic peptide
  Fab XENP20352, scFv XENP20389 vlCDR3
TGHLGPFDL

SEQ ID NO: 29087 - protein, 246 aa, Artificial Sequence; identical to SEQ ID NO: 7442
  Description of Artificial Sequence: Synthetic polypeptide
  Fab XENP20352, scFv XENP20389 scFv

SEQ ID NO: 29088 - protein, 118 aa, Artificial Sequence; identical to SEQ ID NO: 7137
  Description of Artificial Sequence: Synthetic polypeptide
  VH of Fab XENP20353, scFv XENP20390

SEQ ID NO: 29089 - protein, 5 aa, Artificial Sequence
  Description of Artificial Sequence: Synthetic peptide
  Fab XENP20353, scFv XENP20390 vhCDR1
SYTMH

SEQ ID NO: 29090 - protein, 17 aa, Artificial Sequence
  Description of Artificial Sequence: Synthetic peptide
  Fab XENP20353, scFv XENP20390 vhCDR2
FISYDGNHKYYADSVKG

SEQ ID NO: 29091 - protein, 9 aa, Artificial Sequence
  Description of Artificial Sequence: Synthetic peptide
  Fab XENP20353, scFv XENP20390 vhCDR3
TGHLGPFDL

SEQ ID NO: 29092 - protein, 20 aa, Artificial Sequence
  Description of Artificial Sequence: Synthetic peptide
  Fab XENP20353, scFv XENP20390 scFv linker
GKPGSGKPGSGKPGSGKPGS

SEQ ID NO: 29093 - protein, 108 aa, Artificial Sequence; identical to SEQ ID NO: 7453
  Description of Artificial Sequence: Synthetic polypeptide
  VL of Fab XENP20353, scFv XENP20390

SEQ ID NO: 29094 - protein, 12 aa, Artificial Sequence
  Description of Artificial Sequence: Synthetic peptide
  Fab XENP20353, scFv XENP20390 vlCDR1
RASQSVSSSYLA

SEQ ID NO: 29095 - protein, 7 aa, Artificial Sequence
  Description of Artificial Sequence: Synthetic peptide
  Fab XENP20353, scFv XENP20390 vlCDR2
GASSRAT

SEQ ID NO: 29096 - protein, 9 aa, Artificial Sequence
  Description of Artificial Sequence: Synthetic peptide
  Fab XENP20353, scFv XENP20390 vlCDR3
QQYGSSPWT

SEQ ID NO: 29097 - protein, 246 aa, Artificial Sequence; identical to SEQ ID NO: 7451
  Description of Artificial Sequence: Synthetic polypeptide
  Fab XENP20353, scFv XENP20390 scFv

SEQ ID NO: 29098 - protein, 118 aa, Artificial Sequence; identical to SEQ ID NO: 7137
  Description of Artificial Sequence: Synthetic polypeptide
  VH of Fab XENP20354, scFv XENP20391

SEQ ID NO: 29099 - protein, 5 aa, Artificial Sequence
  Description of Artificial Sequence: Synthetic peptide
  Fab XENP20354, scFv XENP20391 vhCDR1
SYTMH

SEQ ID NO: 29100 - protein, 17 aa, Artificial Sequence
  Description of Artificial Sequence: Synthetic peptide
  Fab XENP20354, scFv XENP20391 vhCDR2
FISYDGNHKYYADSVKG

SEQ ID NO: 29101 - protein, 9 aa, Artificial Sequence
  Description of Artificial Sequence: Synthetic peptide
  Fab XENP20354, scFv XENP20391 vhCDR3
TGHLGPFDL

SEQ ID NO: 29102 - protein, 20 aa, Artificial Sequence
  Description of Artificial Sequence: Synthetic peptide
  Fab XENP20354, scFv XENP20391 scFv linker
GKPGSGKPGSGKPGSGKPGS

SEQ ID NO: 29103 - protein, 108 aa, Artificial Sequence; identical to SEQ ID NO: 7462
  Description of Artificial Sequence: Synthetic polypeptide
  VL of Fab XENP20354, scFv XENP20391

SEQ ID NO: 29104 - protein, 12 aa, Artificial Sequence
  Description of Artificial Sequence: Synthetic peptide
  Fab XENP20354, scFv XENP20391 vlCDR1
RASQSVSSSYLA

SEQ ID NO: 29105 - protein, 7 aa, Artificial Sequence
  Description of Artificial Sequence: Synthetic peptide
  Fab XENP20354, scFv XENP20391 vlCDR2
GASSRAT

SEQ ID NO: 29106 - protein, 9 aa, Artificial Sequence
  Description of Artificial Sequence: Synthetic peptide
  Fab XENP20354, scFv XENP20391 vlCDR3
QQYGSSPWT

SEQ ID NO: 29107 - protein, 246 aa, Artificial Sequence; identical to SEQ ID NO: 7460
  Description of Artificial Sequence: Synthetic polypeptide
  Fab XENP20354, scFv XENP20391 scFv

SEQ ID NO: 29108 - protein, 118 aa, Artificial Sequence; identical to SEQ ID NO: 7137
  Description of Artificial Sequence: Synthetic polypeptide
  VH of Fab XENP20355, scFv XENP20392

SEQ ID NO: 29109 - protein, 5 aa, Artificial Sequence
  Description of Artificial Sequence: Synthetic peptide
  Fab XENP20355, scFv XENP20392 vhCDR1
SYTMH

SEQ ID NO: 29110 - protein, 17 aa, Artificial Sequence
  Description of Artificial Sequence: Synthetic peptide
  Fab XENP20355, scFv XENP20392 vhCDR2
FISYDGNHKYYADSVKG

SEQ ID NO: 29111 - protein, 9 aa, Artificial Sequence
  Description of Artificial Sequence: Synthetic peptide
  Fab XENP20355, scFv XENP20392 vhCDR3
TGHLGPFDL

SEQ ID NO: 29112 - protein, 20 aa, Artificial Sequence
  Description of Artificial Sequence: Synthetic peptide
  Fab XENP20355, scFv XENP20392 scFv linker
GKPGSGKPGSGKPGSGKPGS

SEQ ID NO: 29113 - protein, 108 aa, Artificial Sequence; identical to SEQ ID NO: 7471
  Description of Artificial Sequence: Synthetic polypeptide
  VL of Fab XENP20355, scFv XENP20392

SEQ ID NO: 29114 - protein, 12 aa, Artificial Sequence
  Description of Artificial Sequence: Synthetic peptide
  Fab XENP20355, scFv XENP20392 vlCDR1
RASQSVSSSYLA

SEQ ID NO: 29115 - protein, 7 aa, Artificial Sequence
  Description of Artificial Sequence: Synthetic peptide
  Fab XENP20355, scFv XENP20392 vlCDR2
GASSRAT

SEQ ID NO: 29116 - protein, 9 aa, Artificial Sequence
  Description of Artificial Sequence: Synthetic peptide
  Fab XENP20355, scFv XENP20392 vlCDR3
QQYGSSPWT

SEQ ID NO: 29117 - protein, 246 aa, Artificial Sequence; identical to SEQ ID NO: 7469
  Description of Artificial Sequence: Synthetic polypeptide
  Fab XENP20355, scFv XENP20392 scFv

SEQ ID NO: 29118 - protein, 118 aa, Artificial Sequence; identical to SEQ ID NO: 7146
  Description of Artificial Sequence: Synthetic polypeptide
  VH of Fab XENP20357, scFv XENP20394

SEQ ID NO: 29119 - protein, 5 aa, Artificial Sequence
  Description of Artificial Sequence: Synthetic peptide
  Fab XENP20357, scFv XENP20394 vhCDR1
SYTMH

SEQ ID NO: 29120 - protein, 17 aa, Artificial Sequence
  Description of Artificial Sequence: Synthetic peptide
  Fab XENP20357, scFv XENP20394 vhCDR2
FISYDGNTKYYADSVKG

SEQ ID NO: 29121 - protein, 9 aa, Artificial Sequence
  Description of Artificial Sequence: Synthetic peptide
  Fab XENP20357, scFv XENP20394 vhCDR3
TGHLGPFDL

SEQ ID NO: 29122 - protein, 20 aa, Artificial Sequence
  Description of Artificial Sequence: Synthetic peptide
  Fab XENP20357, scFv XENP20394 scFv linker
GKPGSGKPGSGKPGSGKPGS

SEQ ID NO: 29123 - protein, 108 aa, Artificial Sequence; identical to SEQ ID NO: 7489
  Description of Artificial Sequence: Synthetic polypeptide
  VL of Fab XENP20357, scFv XENP20394

SEQ ID NO: 29124 - protein, 12 aa, Artificial Sequence
  Description of Artificial Sequence: Synthetic peptide
  Fab XENP20357, scFv XENP20394 vlCDR1
RASQSVSSSYLA

SEQ ID NO: 29125 - protein, 7 aa, Artificial Sequence
  Description of Artificial Sequence: Synthetic peptide
  Fab XENP20357, scFv XENP20394 vlCDR2
GAFSRAT

SEQ ID NO: 29126 - protein, 9 aa, Artificial Sequence
  Description of Artificial Sequence: Synthetic peptide
  Fab XENP20357, scFv XENP20394 vlCDR3
QQYGSSPWT

SEQ ID NO: 29127 - protein, 246 aa, Artificial Sequence; identical to SEQ ID NO: 7487
  Description of Artificial Sequence: Synthetic polypeptide
  Fab XENP20357, scFv XENP20394 scFv

SEQ ID NO: 29128 - protein, 118 aa, Artificial Sequence; identical to SEQ ID NO: 7146
  Description of Artificial Sequence: Synthetic polypeptide
  VH of Fab XENP20358, scFv XENP20395

SEQ ID NO: 29129 - protein, 5 aa, Artificial Sequence
  Description of Artificial Sequence: Synthetic peptide
  Fab XENP20358, scFv XENP20395 vhCDR1
SYTMH

SEQ ID NO: 29130 - protein, 17 aa, Artificial Sequence
  Description of Artificial Sequence: Synthetic peptide
  Fab XENP20358, scFv XENP20395 vhCDR2
FISYDGNTKYYADSVKG

SEQ ID NO: 29131 - protein, 9 aa, Artificial Sequence
  Description of Artificial Sequence: Synthetic peptide
  Fab XENP20358, scFv XENP20395 vhCDR3
TGHLGPFDL

SEQ ID NO: 29132 - protein, 20 aa, Artificial Sequence
  Description of Artificial Sequence: Synthetic peptide
  Fab XENP20358, scFv XENP20395 scFv linker
GKPGSGKPGSGKPGSGKPGS

SEQ ID NO: 29133 - protein, 108 aa, Artificial Sequence; identical to SEQ ID NO: 7498
  Description of Artificial Sequence: Synthetic polypeptide
  VL of Fab XENP20358, scFv XENP20395

SEQ ID NO: 29134 - protein, 12 aa, Artificial Sequence
  Description of Artificial Sequence: Synthetic peptide
  Fab XENP20358, scFv XENP20395 vlCDR1
RASQSVGSSYLA

SEQ ID NO: 29135 - protein, 7 aa, Artificial Sequence
  Description of Artificial Sequence: Synthetic peptide
  Fab XENP20358, scFv XENP20395 vlCDR2
GASSRAT

SEQ ID NO: 29136 - protein, 9 aa, Artificial Sequence
  Description of Artificial Sequence: Synthetic peptide
  Fab XENP20358, scFv XENP20395 vlCDR3
QQYGSSPWT

SEQ ID NO: 29137 - protein, 246 aa, Artificial Sequence; identical to SEQ ID NO: 7496
  Description of Artificial Sequence: Synthetic polypeptide
  Fab XENP20358, scFv XENP20395 scFv

SEQ ID NO: 29138 - protein, 118 aa, Artificial Sequence; identical to SEQ ID NO: 7146
  Description of Artificial Sequence: Synthetic polypeptide
  VH of Fab XENP20359, scFv XENP20396

SEQ ID NO: 29139 - protein, 5 aa, Artificial Sequence
  Description of Artificial Sequence: Synthetic peptide
  Fab XENP20359, scFv XENP20396 vhCDR1
SYTMH

SEQ ID NO: 29140 - protein, 17 aa, Artificial Sequence
  Description of Artificial Sequence: Synthetic peptide
  Fab XENP20359, scFv XENP20396 vhCDR2
FISYDGNTKYYADSVKG

SEQ ID NO: 29141 - protein, 9 aa, Artificial Sequence
  Description of Artificial Sequence: Synthetic peptide
  Fab XENP20359, scFv XENP20396 vhCDR3
TGHLGPFDL

SEQ ID NO: 29142 - protein, 20 aa, Artificial Sequence
  Description of Artificial Sequence: Synthetic peptide
  Fab XENP20359, scFv XENP20396 scFv linker
GKPGSGKPGSGKPGSGKPGS

SEQ ID NO: 29143 - protein, 108 aa, Artificial Sequence; identical to SEQ ID NO: 7507
  Description of Artificial Sequence: Synthetic polypeptide
  VL of Fab XENP20359, scFv XENP20396

SEQ ID NO: 29144 - protein, 12 aa, Artificial Sequence
  Description of Artificial Sequence: Synthetic peptide
  Fab XENP20359, scFv XENP20396 vlCDR1
RASQSVSSSYLA

SEQ ID NO: 29145 - protein, 7 aa, Artificial Sequence
  Description of Artificial Sequence: Synthetic peptide
  Fab XENP20359, scFv XENP20396 vlCDR2
GASSRAT

SEQ ID NO: 29146 - protein, 9 aa, Artificial Sequence
  Description of Artificial Sequence: Synthetic peptide
  Fab XENP20359, scFv XENP20396 vlCDR3
QQYGSSPWT

SEQ ID NO: 29147 - protein, 246 aa, Artificial Sequence; identical to SEQ ID NO: 7505
  Description of Artificial Sequence: Synthetic polypeptide
  Fab XENP20359, scFv XENP20396 scFv

SEQ ID NO: 29148 - protein, 118 aa, Artificial Sequence; identical to SEQ ID NO: 2405
  Description of Artificial Sequence: Synthetic polypeptide
  VH of Fab XENP19546, scFv XENP19553

SEQ ID NO: 29149 - protein, 5 aa, Artificial Sequence
  Description of Artificial Sequence: Synthetic peptide
  Fab XENP19546, scFv XENP19553 vhCDR1
SYTMH

SEQ ID NO: 29150 - protein, 17 aa, Artificial Sequence
  Description of Artificial Sequence: Synthetic peptide
  Fab XENP19546, scFv XENP19553 vhCDR2
FISYDGNNKYYADSVKG

SEQ ID NO: 29151 - protein, 9 aa, Artificial Sequence
  Description of Artificial Sequence: Synthetic peptide
  Fab XENP19546, scFv XENP19553 vhCDR3
TGWLGPFDY

SEQ ID NO: 29152 - protein, 20 aa, Artificial Sequence
  Description of Artificial Sequence: Synthetic peptide
  Fab XENP19546, scFv XENP19553 scFv linker
GKPGSGKPGSGKPGSGKPGS

SEQ ID NO: 29153 - protein, 108 aa, Artificial Sequence; identical to SEQ ID NO: 3741
  Description of Artificial Sequence: Synthetic polypeptide
  VL of Fab XENP19546, scFv XENP19553

SEQ ID NO: 29154 - protein, 12 aa, Artificial Sequence
  Description of Artificial Sequence: Synthetic peptide
  Fab XENP19546, scFv XENP19553 vlCDR1
RASQSVGSSYLA

SEQ ID NO: 29155 - protein, 7 aa, Artificial Sequence
  Description of Artificial Sequence: Synthetic peptide
  Fab XENP19546, scFv XENP19553 vlCDR2
GAFSRAT

SEQ ID NO: 29156 - protein, 9 aa, Artificial Sequence
  Description of Artificial Sequence: Synthetic peptide
  Fab XENP19546, scFv XENP19553 vlCDR3
QQYGSSPWT

SEQ ID NO: 29157 - protein, 246 aa, Artificial Sequence; identical to SEQ ID NO: 4814
  Description of Artificial Sequence: Synthetic polypeptide
  Fab XENP19546, scFv XENP19553 scFv

SEQ ID NO: 29158 - protein, 118 aa, Artificial Sequence; identical to SEQ ID NO: 2405
  Description of Artificial Sequence: Synthetic polypeptide
  VH of XENP20011

SEQ ID NO: 29159 - protein, 5 aa, Artificial Sequence
  Description of Artificial Sequence: Synthetic peptide
  XENP20011 vhCDR1
SYTMH

SEQ ID NO: 29160 - protein, 17 aa, Artificial Sequence
  Description of Artificial Sequence: Synthetic peptide
  XENP20011 vhCDR2
FISYDGNNKYYADSVKG

SEQ ID NO: 29161 - protein, 9 aa, Artificial Sequence
  Description of Artificial Sequence: Synthetic peptide
  XENP20011 vhCDR3
TGWLGPFDY

SEQ ID NO: 29162 - protein, 20 aa, Artificial Sequence
  Description of Artificial Sequence: Synthetic peptide
  XENP20011 scFv linker
GKPGSGKPGSGKPGSGKPGS

SEQ ID NO: 29163 - protein, 108 aa, Artificial Sequence; identical to SEQ ID NO: 2411
  Description of Artificial Sequence: Synthetic polypeptide
  VL of XENP20011

SEQ ID NO: 29164 - protein, 12 aa, Artificial Sequence
  Description of Artificial Sequence: Synthetic peptide
  XENP20011 vlCDR1
RASQSVSSSYLA

SEQ ID NO: 29165 - protein, 7 aa, Artificial Sequence
  Description of Artificial Sequence: Synthetic peptide
  XENP20011 vlCDR2
GAFSRAT

SEQ ID NO: 29166 - protein, 9 aa, Artificial Sequence
  Description of Artificial Sequence: Synthetic peptide
  XENP20011 vlCDR3
QQYGSSPWT

SEQ ID NO: 29167 - protein, 246 aa, Artificial Sequence
  Description of Artificial Sequence: Synthetic polypeptide
  XENP20011 scFv
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVSSSYLAWYQQKPGQAPRLLIYGAFSRATGIPDRFSGSGSGTDFTLTISRLEPEDFAVYYCQQYGSSPWTFGQGTKVEIK

SEQ ID NO: 29168 - protein, 118 aa, Artificial Sequence; identical to SEQ ID NO: 2405
  Description of Artificial Sequence: Synthetic polypeptide
  VH of XENP20052

SEQ ID NO: 29169 - protein, 5 aa, Artificial Sequence
  Description of Artificial Sequence: Synthetic peptide
  XENP20052 vhCDR1
SYTMH

SEQ ID NO: 29170 - protein, 17 aa, Artificial Sequence
  Description of Artificial Sequence: Synthetic peptide
  XENP20052 vhCDR2
FISYDGNNKYYADSVKG

SEQ ID NO: 29171 - protein, 9 aa, Artificial Sequence
  Description of Artificial Sequence: Synthetic peptide
  XENP20052 vhCDR3
TGWLGPFDY

SEQ ID NO: 29172 - protein, 20 aa, Artificial Sequence
  Description of Artificial Sequence: Synthetic peptide
  XENP20052 scFv linker
GKPGSGKPGSGKPGSGKPGS

SEQ ID NO: 29173 - protein, 108 aa, Artificial Sequence; identical to SEQ ID NO: 6481
  Description of Artificial Sequence: Synthetic polypeptide
  VL of XENP20052

SEQ ID NO: 29174 - protein, 12 aa, Artificial Sequence
  Description of Artificial Sequence: Synthetic peptide
  XENP20052 vlCDR1
RASQSVGSSYLS

SEQ ID NO: 29175 - protein, 7 aa, Artificial Sequence
  Description of Artificial Sequence: Synthetic peptide
  XENP20052 vlCDR2
GAFSRAT

SEQ ID NO: 29176 - protein, 9 aa, Artificial Sequence
  Description of Artificial Sequence: Synthetic peptide
  XENP20052 vlCDR3
QQYGSSPWT

SEQ ID NO: 29177 - protein, 246 aa, Artificial Sequence
  Description of Artificial Sequence: Synthetic polypeptide
  XENP20052 scFv
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLSWYQQKPGQAPRLLIYGAFSRATGIPDRFSGSGSGTDFTLTISRLEPEDFAVYYCQQYGSSPWTFGQGTKVEIK

SEQ ID NO: 29178 - protein, 118 aa, Artificial Sequence; identical to SEQ ID NO: 2405
  Description of Artificial Sequence: Synthetic polypeptide
  VH of XENP20018

SEQ ID NO: 29179 - protein, 5 aa, Artificial Sequence
  Description of Artificial Sequence: Synthetic peptide
  XENP20018 vhCDR1
SYTMH

SEQ ID NO: 29180 - protein, 17 aa, Artificial Sequence
  Description of Artificial Sequence: Synthetic peptide
  XENP20018 vhCDR2
FISYDGNNKYYADSVKG

SEQ ID NO: 29181 - protein, 9 aa, Artificial Sequence
  Description of Artificial Sequence: Synthetic peptide
  XENP20018 vhCDR3
TGWLGPFDY

SEQ ID NO: 29182 - protein, 20 aa, Artificial Sequence
  Description of Artificial Sequence: Synthetic peptide
  XENP20018 scFv linker
GKPGSGKPGSGKPGSGKPGS

SEQ ID NO: 29183 - protein, 108 aa, Artificial Sequence; identical to SEQ ID NO: 6688
  Description of Artificial Sequence: Synthetic polypeptide
  VL of XENP20018

SEQ ID NO: 29184 - protein, 12 aa, Artificial Sequence
  Description of Artificial Sequence: Synthetic peptide
  XENP20018 vlCDR1
RASQSVGSSYLA

SEQ ID NO: 29185 - protein, 7 aa, Artificial Sequence
  Description of Artificial Sequence: Synthetic peptide
  XENP20018 vlCDR2
DAFSRAT

SEQ ID NO: 29186 - protein, 9 aa, Artificial Sequence
  Description of Artificial Sequence: Synthetic peptide
  XENP20018 vlCDR3
QQYGSSPWT

SEQ ID NO: 29187 - protein, 246 aa, Artificial Sequence
  Description of Artificial Sequence: Synthetic polypeptide
  XENP20018 scFv
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYDAFSRATGIPDRFSGSGSGTDFTLTISRLEPEDFAVYYCQQYGSSPWTFGQGTKVEIK

SEQ ID NO: 29188 - protein, 118 aa, Artificial Sequence; identical to SEQ ID NO: 2405
  Description of Artificial Sequence: Synthetic polypeptide
  VH of XENP20020

SEQ ID NO: 29189 - protein, 5 aa, Artificial Sequence
  Description of Artificial Sequence: Synthetic peptide
  XENP20020 vhCDR1
SYTMH

SEQ ID NO: 29190 - protein, 17 aa, Artificial Sequence
  Description of Artificial Sequence: Synthetic peptide
  XENP20020 vhCDR2
FISYDGNNKYYADSVKG

SEQ ID NO: 29191 - protein, 9 aa, Artificial Sequence
  Description of Artificial Sequence: Synthetic peptide
  XENP20020 vhCDR3
TGWLGPFDY

SEQ ID NO: 29192 - protein, 20 aa, Artificial Sequence
  Description of Artificial Sequence: Synthetic peptide
  XENP20020 scFv linker
GKPGSGKPGSGKPGSGKPGS

SEQ ID NO: 29193 - protein, 108 aa, Artificial Sequence; identical to SEQ ID NO: 6751
  Description of Artificial Sequence: Synthetic polypeptide
  VL of XENP20020

SEQ ID NO: 29194 - protein, 12 aa, Artificial Sequence
  Description of Artificial Sequence: Synthetic peptide
  XENP20020 vlCDR1
RASQSVGSSYLA

SEQ ID NO: 29195 - protein, 7 aa, Artificial Sequence
  Description of Artificial Sequence: Synthetic peptide
  XENP20020 vlCDR2
GAYSRAT

SEQ ID NO: 29196 - protein, 9 aa, Artificial Sequence
  Description of Artificial Sequence: Synthetic peptide
  XENP20020 vlCDR3
QQYGSSPWT

SEQ ID NO: 29197 - protein, 246 aa, Artificial Sequence
  Description of Artificial Sequence: Synthetic polypeptide
  XENP20020 scFv
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSGKPGSGKPGSGKPGSGKPGSEIVLTQSPGTLSLSPGERATLSCRASQSVGSSYLAWYQQKPGQAPRLLIYGAYSRATGIPDRFSGSGSGTDFTLTISRLEPEDFAVYYCQQYGSSPWTFGQGTKVEIK

SEQ ID NO: 29198 - protein, 121 aa, Artificial Sequence; identical to SEQ ID NO: 2516
  Description of Artificial Sequence: Synthetic polypeptide
  VH of XENP22594

SEQ ID NO: 29199 - protein, 5 aa, Artificial Sequence
  Description of Artificial Sequence: Synthetic peptide
  XENP22594 vhCDR1
DAWMS

SEQ ID NO: 29200 - protein, 19 aa, Artificial Sequence
  Description of Artificial Sequence: Synthetic peptide
  XENP22594 vhCDR2
EISTKANNHATYYAESVKG

SEQ ID NO: 29201 - protein, 10 aa, Artificial Sequence
  Description of Artificial Sequence: Synthetic peptide
  XENP22594 vhCDR3
LATWDWYFDV

SEQ ID NO: 29202 - protein, 111 aa, Artificial Sequence; identical to SEQ ID NO: 2421
  Description of Artificial Sequence: Synthetic polypeptide
  VL of XENP22594

SEQ ID NO: 29203 - protein, 15 aa, Artificial Sequence
  Description of Artificial Sequence: Synthetic peptide
  XENP22594 vlCDR1
RASQSVDYDGDSYMN

SEQ ID NO: 29204 - protein, 7 aa, Artificial Sequence
  Description of Artificial Sequence: Synthetic peptide
  XENP22594 vlCDR2
AASELES

SEQ ID NO: 29205 - protein, 9 aa, Artificial Sequence
  Description of Artificial Sequence: Synthetic peptide
  XENP22594 vlCDR3
QQSNEDPFT

SEQ ID NO: 29206 - protein, 118 aa, Artificial Sequence; identical to SEQ ID NO: 2646
  Description of Artificial Sequence: Synthetic polypeptide
  VH of XENP22656

SEQ ID NO: 29207 - protein, 5 aa, Artificial Sequence
  Description of Artificial Sequence: Synthetic peptide
  XENP22656 vhCDR1
DYFMH

SEQ ID NO: 29208 - protein, 17 aa, Artificial Sequence
  Description of Artificial Sequence: Synthetic peptide
  XENP22656 vhCDR2
WIDPELGDTEYAPKFQG

SEQ ID NO: 29209 - protein, 9 aa, Artificial Sequence
  Description of Artificial Sequence: Synthetic peptide
  XENP22656 vhCDR3
RGVYQALDY

SEQ ID NO: 29210 - protein, 107 aa, Artificial Sequence; identical to SEQ ID NO: 2661
  Description of Artificial Sequence: Synthetic polypeptide
  VL of XENP22656

SEQ ID NO: 29211 - protein, 11 aa, Artificial Sequence
  Description of Artificial Sequence: Synthetic peptide
  XENP22656 vlCDR1
QASQDIGNYLN

SEQ ID NO: 29212 - protein, 7 aa, Artificial Sequence
  Description of Artificial Sequence: Synthetic peptide
  XENP22656 vlCDR2
FTSYLHS

SEQ ID NO: 29213 - protein, 9 aa, Artificial Sequence
  Description of Artificial Sequence: Synthetic peptide
  XENP22656 vlCDR3
QQGNTLPYT

SEQ ID NO: 29214 - protein, 121 aa, Artificial Sequence
  Description of Artificial Sequence: Synthetic polypeptide
  VH of XENP21670
EVQLVESGGGLVQPGGSLRLSCAASGFTFDDAWMDWVRQAPGKGLEWVAEISTKANNHATYYAESVKGRFTISRDDSKSSVYLQMNSLRAEDTAVYYCTRLATWDWYFDVWGQGTTVTVSS

SEQ ID NO: 29215 - protein, 5 aa, Artificial Sequence
  Description of Artificial Sequence: Synthetic peptide
  XENP21670 vhCDR1
DAWMD

SEQ ID NO: 29216 - protein, 19 aa, Artificial Sequence
  Description of Artificial Sequence: Synthetic peptide
  XENP21670 vhCDR2
EISTKANNHATYYAESVKG

SEQ ID NO: 29217 - protein, 10 aa, Artificial Sequence
  Description of Artificial Sequence: Synthetic peptide
  XENP21670 vhCDR3
LATWDWYFDV

SEQ ID NO: 29218 - protein, 111 aa, Artificial Sequence
  Description of Artificial Sequence: Synthetic polypeptide
  VL of XENP21670
DTVLTQSPSSLSASVGDRVTITCRASQSVDYDGDSYMNWYQQKPGKPPKLLIYAASELESGIPARLSGSGSGTDFTLTISSLQPEDFATYYCQQSNEDPFTFGSGTKLEIK

SEQ ID NO: 29219 - protein, 15 aa, Artificial Sequence
  Description of Artificial Sequence: Synthetic peptide
  XENP21670 vlCDR1
RASQSVDYDGDSYMN

SEQ ID NO: 29220 - protein, 7 aa, Artificial Sequence
  Description of Artificial Sequence: Synthetic peptide
  XENP21670 vlCDR2
AASELES

SEQ ID NO: 29221 - protein, 9 aa, Artificial Sequence
  Description of Artificial Sequence: Synthetic peptide
  XENP21670 vlCDR3
QQSNEDPFT

SEQ ID NO: 29222 - protein, 121 aa, Artificial Sequence; identical to SEQ ID NO: 22262
  Description of Artificial Sequence: Synthetic polypeptide
  VH of XENP20930

SEQ ID NO: 29223 - protein, 5 aa, Artificial Sequence
  Description of Artificial Sequence: Synthetic peptide
  XENP20930 vhCDR1
DAWMD

SEQ ID NO: 29224 - protein, 19 aa, Artificial Sequence
  Description of Artificial Sequence: Synthetic peptide
  XENP20930 vhCDR2
EIRTKANNHATYYAESVKG

SEQ ID NO: 29225 - protein, 10 aa, Artificial Sequence
  Description of Artificial Sequence: Synthetic peptide
  XENP20930 vhCDR3
LANWDWYFDV

SEQ ID NO: 29226 - protein, 111 aa, Artificial Sequence; identical to SEQ ID NO: 22267
  Description of Artificial Sequence: Synthetic polypeptide
  VL of XENP20930

SEQ ID NO: 29227 - protein, 15 aa, Artificial Sequence
  Description of Artificial Sequence: Synthetic peptide
  XENP20930 vlCDR1
KASQSVDYDGDSYMN

SEQ ID NO: 29228 - protein, 7 aa, Artificial Sequence
  Description of Artificial Sequence: Synthetic peptide
  XENP20930 vlCDR2
AASNLES

SEQ ID NO: 29229 - protein, 9 aa, Artificial Sequence
  Description of Artificial Sequence: Synthetic peptide
  XENP20930 vlCDR3
QQSNEDPFT

SEQ ID NO: 29230 - protein, 118 aa, Artificial Sequence; identical to SEQ ID NO: 2706
  Description of Artificial Sequence: Synthetic polypeptide
  VH of XENP21921

SEQ ID NO: 29231 - protein, 5 aa, Artificial Sequence
  Description of Artificial Sequence: Synthetic peptide
  XENP21921 vhCDR1
HYFMH

SEQ ID NO: 29232 - protein, 17 aa, Artificial Sequence
  Description of Artificial Sequence: Synthetic peptide
  XENP21921 vhCDR2
WIDPYLGDTEYAPKFQG

SEQ ID NO: 29233 - protein, 9 aa, Artificial Sequence
  Description of Artificial Sequence: Synthetic peptide
  XENP21921 vhCDR3
RGVYQALDY

SEQ ID NO: 29234 - protein, 107 aa, Artificial Sequence; identical to SEQ ID NO: 2681
  Description of Artificial Sequence: Synthetic polypeptide
  VL of XENP21921

SEQ ID NO: 29235 - protein, 11 aa, Artificial Sequence
  Description of Artificial Sequence: Synthetic peptide
  XENP21921 vlCDR1
QASQDIGNYLN

SEQ ID NO: 29236 - protein, 7 aa, Artificial Sequence
  Description of Artificial Sequence: Synthetic peptide
  XENP21921 vlCDR2
FTSYLHS

SEQ ID NO: 29237 - protein, 9 aa, Artificial Sequence
  Description of Artificial Sequence: Synthetic peptide
  XENP21921 vlCDR3
QQGNTLPYT

SEQ ID NO: 29238 - protein, 118 aa, Artificial Sequence; identical to SEQ ID NO: 2686
  Description of Artificial Sequence: Synthetic polypeptide
  VH of XENP20847

SEQ ID NO: 29239 - protein, 5 aa, Artificial Sequence
  Description of Artificial Sequence: Synthetic peptide
  XENP20847 vhCDR1
DYYMH

SEQ ID NO: 29240 - protein, 17 aa, Artificial Sequence
  Description of Artificial Sequence: Synthetic peptide
  XENP20847 vhCDR2
WIDPENGDTEYAPKFQG

SEQ ID NO: 29241 - protein, 9 aa, Artificial Sequence
  Description of Artificial Sequence: Synthetic peptide
  XENP20847 vhCDR3
RGVRQALDY

SEQ ID NO: 29242 - protein, 107 aa, Artificial Sequence; identical to SEQ ID NO: 2881
  Description of Artificial Sequence: Synthetic polypeptide
  VL of XENP20847

SEQ ID NO: 29243 - protein, 11 aa, Artificial Sequence
  Description of Artificial Sequence: Synthetic peptide
  XENP20847 vlCDR1
QASQDIGNYLN

SEQ ID NO: 29244 - protein, 7 aa, Artificial Sequence
  Description of Artificial Sequence: Synthetic peptide
  XENP20847 vlCDR2
YTSRLHS

SEQ ID NO: 29245 - protein, 9 aa, Artificial Sequence
  Description of Artificial Sequence: Synthetic peptide
  XENP20847 vlCDR3
QQGNTLPYT

SEQ ID NO: 29246 - protein, 118 aa, Artificial Sequence; identical to SEQ ID NO: 2686
  Description of Artificial Sequence: Synthetic polypeptide
  VH of XENP21372

SEQ ID NO: 29247 - protein, 5 aa, Artificial Sequence
  Description of Artificial Sequence: Synthetic peptide
  XENP21372 vhCDR1
DYYMH

SEQ ID NO: 29248 - protein, 17 aa, Artificial Sequence
  Description of Artificial Sequence: Synthetic peptide
  XENP21372 vhCDR2
WIDPENGDTEYAPKFQG

SEQ ID NO: 29249 - protein, 9 aa, Artificial Sequence
  Description of Artificial Sequence: Synthetic peptide
  XENP21372 vhCDR3
RGVRQALDY

SEQ ID NO: 29250 - protein, 107 aa, Artificial Sequence
  Description of Artificial Sequence: Synthetic polypeptide
  VL of XENP21372
DIQMTQSPAFLSVTPGEKVTITCQASQDIGNHLNWFQQKPDQTVKLLIYYTSRLHSGVPSRFSGSGSGTDYTFTISSLEAEDAATYFCQQGNTLPYTFGGGTKVEIK

SEQ ID NO: 29251 - protein, 11 aa, Artificial Sequence
  Description of Artificial Sequence: Synthetic peptide
  XENP21372 vlCDR1
QASQDIGNHLN

SEQ ID NO: 29252 - protein, 7 aa, Artificial Sequence
  Description of Artificial Sequence: Synthetic peptide
  XENP21372 vlCDR2
YTSRLHS

SEQ ID NO: 29253 - protein, 9 aa, Artificial Sequence
  Description of Artificial Sequence: Synthetic peptide
  XENP21372 vlCDR3
QQGNTLPYT

SEQ ID NO: 29254 - protein, 118 aa, Artificial Sequence; identical to SEQ ID NO: 2686
  Description of Artificial Sequence: Synthetic polypeptide
  VH of XENP21394

SEQ ID NO: 29255 - protein, 5 aa, Artificial Sequence
  Description of Artificial Sequence: Synthetic peptide
  XENP21394 vhCDR1
DYYMH

SEQ ID NO: 29256 - protein, 17 aa, Artificial Sequence
  Description of Artificial Sequence: Synthetic peptide
  XENP21394 vhCDR2
WIDPENGDTEYAPKFQG

SEQ ID NO: 29257 - protein, 9 aa, Artificial Sequence
  Description of Artificial Sequence: Synthetic peptide
  XENP21394 vhCDR3
RGVRQALDY

SEQ ID NO: 29258 - protein, 107 aa, Artificial Sequence
  Description of Artificial Sequence: Synthetic polypeptide
  VL of XENP21394
DIQMTQSPAFLSVTPGEKVTITCQASQDIGNYLNWFQQKPDQTVKLLIYYTSHLHSGVPSRFSGSGSGTDYTFTISSLEAEDAATYFCQQGNTLPYTFGGGTKVEIK

SEQ ID NO: 29259 - protein, 11 aa, Artificial Sequence
  Description of Artificial Sequence: Synthetic peptide
  XENP21394 vlCDR1
QASQDIGNYLN

SEQ ID NO: 29260 - protein, 7 aa, Artificial Sequence
  Description of Artificial Sequence: Synthetic peptide
  XENP21394 vlCDR2
YTSHLHS

SEQ ID NO: 29261 - protein, 9 aa, Artificial Sequence
  Description of Artificial Sequence: Synthetic peptide
  XENP21394 vlCDR3
QQGNTLPYT

SEQ ID NO: 29262 - protein, 118 aa, Artificial Sequence; identical to SEQ ID NO: 2686
  Description of Artificial Sequence: Synthetic polypeptide
  VH of XENP21401

SEQ ID NO: 29263 - protein, 5 aa, Artificial Sequence
  Description of Artificial Sequence: Synthetic peptide
  XENP21401 vhCDR1
DYYMH

SEQ ID NO: 29264 - protein, 17 aa, Artificial Sequence
  Description of Artificial Sequence: Synthetic peptide
  XENP21401 vhCDR2
WIDPENGDTEYAPKFQG

SEQ ID NO: 29265 - protein, 9 aa, Artificial Sequence
  Description of Artificial Sequence: Synthetic peptide
  XENP21401 vhCDR3
RGVRQALDY

SEQ ID NO: 29266 - protein, 107 aa, Artificial Sequence; identical to SEQ ID NO: 2901
  Description of Artificial Sequence: Synthetic polypeptide
  VL of XENP21401

SEQ ID NO: 29267 - protein, 11 aa, Artificial Sequence
  Description of Artificial Sequence: Synthetic peptide
  XENP21401 vlCDR1
QASQDIGNYLN

SEQ ID NO: 29268 - protein, 7 aa, Artificial Sequence
  Description of Artificial Sequence: Synthetic peptide
  XENP21401 vlCDR2
YTSYLHS

SEQ ID NO: 29269 - protein, 9 aa, Artificial Sequence
  Description of Artificial Sequence: Synthetic peptide
  XENP21401 vlCDR3
QQGNTLPYT

SEQ ID NO: 29270 - protein, 118 aa, Artificial Sequence; identical to SEQ ID NO: 2686
  Description of Artificial Sequence: Synthetic polypeptide
  VH of XENP20847

SEQ ID NO: 29271 - protein, 5 aa, Artificial Sequence
  Description of Artificial Sequence: Synthetic peptide
  XENP20847 vhCDR1
DYYMH

SEQ ID NO: 29272 - protein, 17 aa, Artificial Sequence
  Description of Artificial Sequence: Synthetic peptide
  XENP20847 vhCDR2
WIDPENGDTEYAPKFQG

SEQ ID NO: 29273 - protein, 9 aa, Artificial Sequence
  Description of Artificial Sequence: Synthetic peptide
  XENP20847 vhCDR3
RGVRQALDY

SEQ ID NO: 29274 - protein, 107 aa, Artificial Sequence; identical to SEQ ID NO: 2881
  Description of Artificial Sequence: Synthetic polypeptide
  VL of XENP20847

SEQ ID NO: 29275 - protein, 11 aa, Artificial Sequence
  Description of Artificial Sequence: Synthetic peptide
  XENP20847 vlCDR1
QASQDIGNYLN

SEQ ID NO: 29276 - protein, 7 aa, Artificial Sequence
  Description of Artificial Sequence: Synthetic peptide
  XENP20847 vlCDR2
YTSRLHS

SEQ ID NO: 29277 - protein, 9 aa, Artificial Sequence
  Description of Artificial Sequence: Synthetic peptide
  XENP20847 vlCDR3
QQGNTLPYT

SEQ ID NO: 29278 - protein, 121 aa, Artificial Sequence; identical to SEQ ID NO: 29214
  Description of Artificial Sequence: Synthetic polypeptide
  VH of XENP21670

SEQ ID NO: 29279 - protein, 5 aa, Artificial Sequence
  Description of Artificial Sequence: Synthetic peptide
  XENP21670 vhCDR1
DAWMD

SEQ ID NO: 29280 - protein, 19 aa, Artificial Sequence
  Description of Artificial Sequence: Synthetic peptide
  XENP21670 vhCDR2
EISTKANNHATYYAESVKG

SEQ ID NO: 29281 - protein, 10 aa, Artificial Sequence
  Description of Artificial Sequence: Synthetic peptide
  XENP21670 vhCDR3
LATWDWYFDV

SEQ ID NO: 29282 - protein, 111 aa, Artificial Sequence; identical to SEQ ID NO: 29218
  Description of Artificial Sequence: Synthetic polypeptide
  VL of XENP21670

SEQ ID NO: 29283 - protein, 15 aa, Artificial Sequence
  Description of Artificial Sequence: Synthetic peptide
  XENP21670 vlCDR1
RASQSVDYDGDSYMN

SEQ ID NO: 29284 - protein, 7 aa, Artificial Sequence
  Description of Artificial Sequence: Synthetic peptide
  XENP21670 vlCDR2
AASELES

SEQ ID NO: 29285 - protein, 9 aa, Artificial Sequence
  Description of Artificial Sequence: Synthetic peptide
  XENP21670 vlCDR3
QQSNEDPFT

SEQ ID NO: 29286 - protein, 121 aa, Artificial Sequence
  Description of Artificial Sequence: Synthetic polypeptide
  VH of XENP21892
EVQLVESGGGLVQPGGSLRLSCAASGFTFDDAWMDWVRQAPGKGLEWVAEISTKAYNHATYYAESVKGRFTISRDDSKSSVYLQMNSLRAEDTAVYYCTRLATWDWYFDVWGQGTTVTVSS

SEQ ID NO: 29287 - protein, 5 aa, Artificial Sequence
  Description of Artificial Sequence: Synthetic peptide
  XENP21892 vhCDR1
DAWMD

SEQ ID NO: 29288 - protein, 19 aa, Artificial Sequence
  Description of Artificial Sequence: Synthetic peptide
  XENP21892 vhCDR2
EISTKAYNHATYYAESVKG

SEQ ID NO: 29289 - protein, 10 aa, Artificial Sequence
  Description of Artificial Sequence: Synthetic peptide
  XENP21892 vhCDR3
LATWDWYFDV

SEQ ID NO: 29290 - protein, 111 aa, Artificial Sequence; identical to SEQ ID NO: 22277
  Description of Artificial Sequence: Synthetic polypeptide
  VL of XENP21892

SEQ ID NO: 29291 - protein, 15 aa, Artificial Sequence
  Description of Artificial Sequence: Synthetic peptide
  XENP21892 vlCDR1
RASQSVDYDGDSYMN

SEQ ID NO: 29292 - protein, 7 aa, Artificial Sequence
  Description of Artificial Sequence: Synthetic peptide
  XENP21892 vlCDR2
AASNLES

SEQ ID NO: 29293 - protein, 9 aa, Artificial Sequence
  Description of Artificial Sequence: Synthetic peptide
  XENP21892 vlCDR3
QQSNEDPFT

SEQ ID NO: 29294 - protein, 121 aa, Artificial Sequence; identical to SEQ ID NO: 29286
  Description of Artificial Sequence: Synthetic polypeptide
  VH of XENP21893

SEQ ID NO: 29295 - protein, 5 aa, Artificial Sequence
  Description of Artificial Sequence: Synthetic peptide
  XENP21893 vhCDR1
DAWMD

SEQ ID NO: 29296 - protein, 19 aa, Artificial Sequence
  Description of Artificial Sequence: Synthetic peptide
  XENP21893 vhCDR2
EISTKAYNHATYYAESVKG

SEQ ID NO: 29297 - protein, 10 aa, Artificial Sequence
  Description of Artificial Sequence: Synthetic peptide
  XENP21893 vhCDR3
LATWDWYFDV

SEQ ID NO: 29298 - protein, 111 aa, Artificial Sequence; identical to SEQ ID NO: 29218
  Description of Artificial Sequence: Synthetic polypeptide
  VL of XENP21893

SEQ ID NO: 29299 - protein, 15 aa, Artificial Sequence
  Description of Artificial Sequence: Synthetic peptide
  XENP21893 vlCDR1
RASQSVDYDGDSYMN

SEQ ID NO: 29300 - protein, 7 aa, Artificial Sequence
  Description of Artificial Sequence: Synthetic peptide
  XENP21893 vlCDR2
AASELES

SEQ ID NO: 29301 - protein, 9 aa, Artificial Sequence
  Description of Artificial Sequence: Synthetic peptide
  XENP21893 vlCDR3
QQSNEDPFT

SEQ ID NO: 29302 - protein, 121 aa, Artificial Sequence; identical to SEQ ID NO: 29286
  Description of Artificial Sequence: Synthetic polypeptide
  VH of XENP21894

SEQ ID NO: 29303 - protein, 5 aa, Artificial Sequence
  Description of Artificial Sequence: Synthetic peptide
  XENP21894 vhCDR1
DAWMD

SEQ ID NO: 29304 - protein, 19 aa, Artificial Sequence
  Description of Artificial Sequence: Synthetic peptide
  XENP21894 vhCDR2
EISTKAYNHATYYAESVKG

SEQ ID NO: 29305 - protein, 10 aa, Artificial Sequence
  Description of Artificial Sequence: Synthetic peptide
  XENP21894 vhCDR3
LATWDWYFDV

SEQ ID NO: 29306 - protein, 111 aa, Artificial Sequence
  Description of Artificial Sequence: Synthetic polypeptide
  VL of XENP21894
DTVLTQSPSSLSASVGDRVTITCRASQSVDHDGDSYMNWYQQKPGKPPKLLIYAASELESGIPARLSGSGSGTDFTLTISSLQPEDFATYYCQQSNEDPFTFGSGTKLEIK

SEQ ID NO: 29307 - protein, 15 aa, Artificial Sequence
  Description of Artificial Sequence: Synthetic peptide
  XENP21894 vlCDR1
RASQSVDHDGDSYMN

SEQ ID NO: 29308 - protein, 7 aa, Artificial Sequence
  Description of Artificial Sequence: Synthetic peptide
  XENP21894 vlCDR2
AASELES

SEQ ID NO: 29309 - protein, 9 aa, Artificial Sequence
  Description of Artificial Sequence: Synthetic peptide
  XENP21894 vlCDR3
QQSNEDPFT

SEQ ID NO: 29310 - protein, 113 aa, Artificial Sequence; identical to SEQ ID NO: 3626
  Description of Artificial Sequence: Synthetic polypeptide
  VH of XENP21503

SEQ ID NO: 29311 - protein, 4 aa, Artificial Sequence
  Description of Artificial Sequence: Synthetic peptide
  XENP21503 vhCDR1
SFDM

SEQ ID NO: 29312 - protein, 17 aa, Artificial Sequence
  Description of Artificial Sequence: Synthetic peptide
  XENP21503 vhCDR2
YISSDGASTFYPDTMKG

SEQ ID NO: 29313 - protein, 4 aa, Artificial Sequence
  Description of Artificial Sequence: Synthetic peptide
  XENP21503 vhCDR3
LGAY

SEQ ID NO: 29314 - protein, 112 aa, Artificial Sequence; identical to SEQ ID NO: 3701
  Description of Artificial Sequence: Synthetic polypeptide
  VL of XENP21503

SEQ ID NO: 29315 - protein, 16 aa, Artificial Sequence
  Description of Artificial Sequence: Synthetic peptide
  XENP21503 vlCDR1
KSSQSLLDSDGKTYLN

SEQ ID NO: 29316 - protein, 6 aa, Artificial Sequence
  Description of Artificial Sequence: Synthetic peptide
  XENP21503 vlCDR2
VSKLDS

SEQ ID NO: 29317 - protein, 9 aa, Artificial Sequence
  Description of Artificial Sequence: Synthetic peptide
  XENP21503 vlCDR3
WQGTHFPYT

SEQ ID NO: 29318 - protein, 113 aa, Artificial Sequence; identical to SEQ ID NO: 3626
  Description of Artificial Sequence: Synthetic polypeptide
  VH of XENP21492

SEQ ID NO: 29319 - protein, 5 aa, Artificial Sequence
  Description of Artificial Sequence: Synthetic peptide
  XENP21492 vhCDR1
SFDMS

SEQ ID NO: 29320 - protein, 17 aa, Artificial Sequence
  Description of Artificial Sequence: Synthetic peptide
  XENP21492 vhCDR2
YISSDGASTFYPDTMKG

SEQ ID NO: 29321 - protein, 4 aa, Artificial Sequence
  Description of Artificial Sequence: Synthetic peptide
  XENP21492 vhCDR3
LGAY

SEQ ID NO: 29322 - protein, 111 aa, Artificial Sequence; identical to SEQ ID NO: 3631
  Description of Artificial Sequence: Synthetic polypeptide
  VL of XENP21492

SEQ ID NO: 29323 - protein, 14 aa, Artificial Sequence
  Description of Artificial Sequence: Synthetic peptide
  XENP21492 vlCDR1
RASESVEYYGTSLQ

SEQ ID NO: 29324 - protein, 7 aa, Artificial Sequence
  Description of Artificial Sequence: Synthetic peptide
  XENP21492 vlCDR2
AASNVES

SEQ ID NO: 29325 - protein, 9 aa, Artificial Sequence
  Description of Artificial Sequence: Synthetic peptide
  XENP21492 vlCDR3
QQSRKVPWT

SEQ ID NO: 29326 - protein, 117 aa, Artificial Sequence; identical to SEQ ID NO: 3366
  Description of Artificial Sequence: Synthetic polypeptide
  VH of XENP21189

SEQ ID NO: 29327 - protein, 5 aa, Artificial Sequence
  Description of Artificial Sequence: Synthetic peptide
  XENP21189 vhCDR1
GYGVN

SEQ ID NO: 29328 - protein, 16 aa, Artificial Sequence
  Description of Artificial Sequence: Synthetic peptide
  XENP21189 vhCDR2
MIWGDGSTDYNSALKS

SEQ ID NO: 29329 - protein, 9 aa, Artificial Sequence
  Description of Artificial Sequence: Synthetic peptide
  XENP21189 vhCDR3
SYYTSDEDY

SEQ ID NO: 29330 - protein, 112 aa, Artificial Sequence; identical to SEQ ID NO: 3511
  Description of Artificial Sequence: Synthetic polypeptide
  VL of XENP21189

SEQ ID NO: 29331 - protein, 17 aa, Artificial Sequence
  Description of Artificial Sequence: Synthetic peptide
  XENP21189 vlCDR1
KSSQSLLNSRTRKNYLA

SEQ ID NO: 29332 - protein, 7 aa, Artificial Sequence
  Description of Artificial Sequence: Synthetic peptide
  XENP21189 vlCDR2
WASTRES

SEQ ID NO: 29333 - protein, 8 aa, Artificial Sequence
  Description of Artificial Sequence: Synthetic peptide
  XENP21189 vlCDR3
KQSYSLRT

SEQ ID NO: 29334 - protein, 117 aa, Artificial Sequence; identical to SEQ ID NO: 3636
  Description of Artificial Sequence: Synthetic polypeptide
  VH of XENP21493

SEQ ID NO: 29335 - protein, 5 aa, Artificial Sequence
  Description of Artificial Sequence: Synthetic peptide
  XENP21493 vhCDR1
GYGVN

SEQ ID NO: 29336 - protein, 16 aa, Artificial Sequence
  Description of Artificial Sequence: Synthetic peptide
  XENP21493 vhCDR2
MIWGDGSTDYNSALKS

SEQ ID NO: 29337 - protein, 9 aa, Artificial Sequence
  Description of Artificial Sequence: Synthetic peptide
  XENP21493 vhCDR3
SYYTSDEDY

SEQ ID NO: 29338 - protein, 107 aa, Artificial Sequence; identical to SEQ ID NO: 3641
  Description of Artificial Sequence: Synthetic polypeptide
  VL of XENP21493

SEQ ID NO: 29339 - protein, 11 aa, Artificial Sequence
  Description of Artificial Sequence: Synthetic peptide
  XENP21493 vlCDR1
KASQNVGSNVA

SEQ ID NO: 29340 - protein, 7 aa, Artificial Sequence
  Description of Artificial Sequence: Synthetic peptide
  XENP21493 vlCDR2
SASFRYS

SEQ ID NO: 29341 - protein, 9 aa, Artificial Sequence
  Description of Artificial Sequence: Synthetic peptide
  XENP21493 vlCDR3
QQYNSYPYT

SEQ ID NO: 29342 - protein, 117 aa, Artificial Sequence; identical to SEQ ID NO: 3646
  Description of Artificial Sequence: Synthetic polypeptide
  VH of XENP21494

SEQ ID NO: 29343 - protein, 5 aa, Artificial Sequence
  Description of Artificial Sequence: Synthetic peptide
  XENP21494 vhCDR1
SYGVH

SEQ ID NO: 29344 - protein, 16 aa, Artificial Sequence
  Description of Artificial Sequence: Synthetic peptide
  XENP21494 vhCDR2
VIWSGGSTEYNAAFIS

SEQ ID NO: 29345 - protein, 9 aa, Artificial Sequence
  Description of Artificial Sequence: Synthetic peptide
  XENP21494 vhCDR3
GGLLSPFDY

SEQ ID NO: 29346 - protein, 111 aa, Artificial Sequence; identical to SEQ ID NO: 3631
  Description of Artificial Sequence: Synthetic polypeptide
  VL of XENP21494

SEQ ID NO: 29347 - protein, 15 aa, Artificial Sequence
  Description of Artificial Sequence: Synthetic peptide
  XENP21494 vlCDR1
RASESVEYYGTSLMQ

SEQ ID NO: 29348 - protein, 7 aa, Artificial Sequence
  Description of Artificial Sequence: Synthetic peptide
  XENP21494 vlCDR2
AASNVES

SEQ ID NO: 29349 - protein, 9 aa, Artificial Sequence
  Description of Artificial Sequence: Synthetic peptide
  XENP21494 vlCDR3
QQSRKVPWT

SEQ ID NO: 29350 - protein, 123 aa, Artificial Sequence; identical to SEQ ID NO: 3656
  Description of Artificial Sequence: Synthetic polypeptide
  VH of XENP21495

SEQ ID NO: 29351 - protein, 5 aa, Artificial Sequence
  Description of Artificial Sequence: Synthetic peptide
  XENP21495 vhCDR1
RYWMS

SEQ ID NO: 29352 - protein, 17 aa, Artificial Sequence
  Description of Artificial Sequence: Synthetic peptide
  XENP21495 vhCDR2
EINPDSSTINYTPSLKD

SEQ ID NO: 29353 - protein, 14 aa, Artificial Sequence
  Description of Artificial Sequence: Synthetic peptide
  XENP21495 vhCDR3
PNGYYVGTIFPFAY

SEQ ID NO: 29354 - protein, 110 aa, Artificial Sequence
  Description of Artificial Sequence: Synthetic polypeptide
  VL of XENP21495
QAVVTQESALTTSPGETVTLTCRSSTGAVTTSNYANWVQEKPDHLFTGLIGGTNNRAPGVPARFSGSLIGDKAALTITGAQTEDEAIYFCALWYSNHWVFGGGTKLTVLG

SEQ ID NO: 29355 - protein, 14 aa, Artificial Sequence
  Description of Artificial Sequence: Synthetic peptide
  XENP21495 vlCDR1
RSSTGAVTTSNYAN

SEQ ID NO: 29356 - protein, 7 aa, Artificial Sequence
  Description of Artificial Sequence: Synthetic peptide
  XENP21495 vlCDR2
GTNNRAP

SEQ ID NO: 29357 - protein, 9 aa, Artificial Sequence
  Description of Artificial Sequence: Synthetic peptide
  XENP21495 vlCDR3
ALWYSNHWV

SEQ ID NO: 29358 - protein, 118 aa, Artificial Sequence; identical to SEQ ID NO: 3666
  Description of Artificial Sequence: Synthetic polypeptide
  VH of XENP21496

SEQ ID NO: 29359 - protein, 5 aa, Artificial Sequence
  Description of Artificial Sequence: Synthetic peptide
  XENP21496 vhCDR1
SYAVN

SEQ ID NO: 29360 - protein, 16 aa, Artificial Sequence
  Description of Artificial Sequence: Synthetic peptide
  XENP21496 vhCDR2
VIWSGGSTDYNAAFIS

SEQ ID NO: 29361 - protein, 10 aa, Artificial Sequence
  Description of Artificial Sequence: Synthetic peptide
  XENP21496 vhCDR3
LYYRYDGFDY

SEQ ID NO: 29362 - protein, 107 aa, Artificial Sequence; identical to SEQ ID NO: 25517
  Description of Artificial Sequence: Synthetic polypeptide
  VL of XENP21496

SEQ ID NO: 29363 - protein, 11 aa, Artificial Sequence
  Description of Artificial Sequence: Synthetic peptide
  XENP21496 vlCDR1
KASQNVGTHVA

SEQ ID NO: 29364 - protein, 7 aa, Artificial Sequence
  Description of Artificial Sequence: Synthetic peptide
  XENP21496 vlCDR2
SASYRYS

SEQ ID NO: 29365 - protein, 9 aa, Artificial Sequence
  Description of Artificial Sequence: Synthetic peptide
  XENP21496 vlCDR3
QQYNSYPLT

SEQ ID NO: 29366 - protein, 118 aa, Artificial Sequence; identical to SEQ ID NO: 3676
  Description of Artificial Sequence: Synthetic polypeptide
  VH of XENP21501

SEQ ID NO: 29367 - protein, 5 aa, Artificial Sequence
  Description of Artificial Sequence: Synthetic peptide
  XENP21501 vhCDR1
SYAVN

SEQ ID NO: 29368 - protein, 16 aa, Artificial Sequence
  Description of Artificial Sequence: Synthetic peptide
  XENP21501 vhCDR2
VIWSGGSTDYNAAFIS

SEQ ID NO: 29369 - protein, 10 aa, Artificial Sequence
  Description of Artificial Sequence: Synthetic peptide
  XENP21501 vhCDR3
LYYRYDGFDY

SEQ ID NO: 29370 - protein, 107 aa, Artificial Sequence; identical to SEQ ID NO: 25517
  Description of Artificial Sequence: Synthetic polypeptide
  VL of XENP21501

SEQ ID NO: 29371 - protein, 11 aa, Artificial Sequence
  Description of Artificial Sequence: Synthetic peptide
  XENP21501 vlCDR1
KASQNVGTHVA

SEQ ID NO: 29372 - protein, 7 aa, Artificial Sequence
  Description of Artificial Sequence: Synthetic peptide
  XENP21501 vlCDR2
SASYRYS

SEQ ID NO: 29373 - protein, 9 aa, Artificial Sequence
  Description of Artificial Sequence: Synthetic peptide
  XENP21501 vlCDR3
QQYNSYPLT

SEQ ID NO: 29374 - protein, 117 aa, Artificial Sequence; identical to SEQ ID NO: 3686
  Description of Artificial Sequence: Synthetic polypeptide
  VH of XENP21502

SEQ ID NO: 29375 - protein, 5 aa, Artificial Sequence
  Description of Artificial Sequence: Synthetic peptide
  XENP21502 vhCDR1
RYAMS

SEQ ID NO: 29376 - protein, 16 aa, Artificial Sequence
  Description of Artificial Sequence: Synthetic peptide
  XENP21502 vhCDR2
SISSGGSTYYPDSVQG

SEQ ID NO: 29377 - protein, 9 aa, Artificial Sequence
  Description of Artificial Sequence: Synthetic peptide
  XENP21502 vhCDR3
GDYEGYFDY

SEQ ID NO: 29378 - protein, 113 aa, Artificial Sequence; identical to SEQ ID NO: 3691
  Description of Artificial Sequence: Synthetic polypeptide
  VL of XENP21502

SEQ ID NO: 29379 - protein, 17 aa, Artificial Sequence
  Description of Artificial Sequence: Synthetic peptide
  XENP21502 vlCDR1
KSSQSLLNSINQKNYLA

SEQ ID NO: 29380 - protein, 7 aa, Artificial Sequence
  Description of Artificial Sequence: Synthetic peptide
  XENP21502 vlCDR2
FASTRES

SEQ ID NO: 29381 - protein, 9 aa, Artificial Sequence
  Description of Artificial Sequence: Synthetic peptide
  XENP21502 vlCDR3
QQHYSTPLT

SEQ ID NO: 29382 - protein, 118 aa, Artificial Sequence [sequence omitted]

SEQ ID NO: 29383 - protein, 5 aa, Artificial Sequence
  Description of Artificial Sequence: Synthetic peptide
  XENP016434 vhCDR1
DSWIH

SEQ ID NO: 29384 - protein, 17 aa, Artificial Sequence
  Description of Artificial Sequence: Synthetic peptide
  XENP016434 vhCDR2
WISPYGGSTYYADSVKG

SEQ ID NO: 29385 - protein, 9 aa, Artificial Sequence
  Description of Artificial Sequence: Synthetic peptide
  XENP016434 vhCDR3
RHWPGGFDY

SEQ ID NO: 29386 - protein, 447 aa, Artificial Sequence; identical to SEQ ID NO: 27506
  Description of Artificial Sequence: Synthetic polypeptide
  XENP016434 Full length HC

SEQ ID NO: 29387 - protein, 107 aa, Artificial Sequence [sequence omitted]

SEQ ID NO: 29388 - protein, 11 aa, Artificial Sequence
  Description of Artificial Sequence: Synthetic peptide
  XENP016434 vlCDR1
RASQDVSTAVA

SEQ ID NO: 29389 - protein, 7 aa, Artificial Sequence
  Description of Artificial Sequence: Synthetic peptide
  XENP016434 vlCDR2
SASFLYS

SEQ ID NO: 29390 - protein, 9 aa, Artificial Sequence
  Description of Artificial Sequence: Synthetic peptide
  XENP016434 vlCDR3
QQYLYHPAT

SEQ ID NO: 29391 - protein, 214 aa, Artificial Sequence; identical to SEQ ID NO: 27132
  Description of Artificial Sequence: Synthetic polypeptide
  XENP016434 Full length light chain

SEQ ID NO: 29392 - protein, 120 aa, Artificial Sequence; identical to SEQ ID NO: 3977
  Description of Artificial Sequence: Synthetic polypeptide
  VH of XENP024118

SEQ ID NO: 29393 - protein, 5 aa, Artificial Sequence
  Description of Artificial Sequence: Synthetic peptide
  XENP024118 vhCDR1
SYIMM

SEQ ID NO: 29394 - protein, 17 aa, Artificial Sequence
  Description of Artificial Sequence: Synthetic peptide
  XENP024118 vhCDR2
SIYPSGGITFYADTVKG

SEQ ID NO: 29395 - protein, 11 aa, Artificial Sequence
  Description of Artificial Sequence: Synthetic peptide
  XENP024118 vhCDR3
IKLGTVTTVDY

SEQ ID NO: 29396 - protein, 449 aa, Artificial Sequence; identical to SEQ ID NO: 27516
  Description of Artificial Sequence: Synthetic polypeptide
  XENP024118 Full length HC

SEQ ID NO: 29397 - protein, 110 aa, Artificial Sequence; identical to SEQ ID NO: 3981
  Description of Artificial Sequence: Synthetic polypeptide
  VL of XENP024118

SEQ ID NO: 29398 - protein, 14 aa, Artificial Sequence
  Description of Artificial Sequence: Synthetic peptide
  XENP024118 vlCDR1
TGTSSDVGGYNYVS

SEQ ID NO: 29399 - protein, 7 aa, Artificial Sequence
  Description of Artificial Sequence: Synthetic peptide
  XENP024118 vlCDR2
DVSNRPS

SEQ ID NO: 29400 - protein, 10 aa, Artificial Sequence
  Description of Artificial Sequence: Synthetic peptide
  XENP024118 vlCDR3
SSYTSSSTRV

SEQ ID NO: 29401 - protein, 216 aa, Artificial Sequence; identical to SEQ ID NO: 27172
  Description of Artificial Sequence: Synthetic polypeptide
  XENP024118 Full length light chain

SEQ ID NO: 29402 - protein, 121 aa, Artificial Sequence; identical to SEQ ID NO: 3961
  Description of Artificial Sequence: Synthetic polypeptide
  VH of XENP024119

SEQ ID NO: 29403 - protein, 5 aa, Artificial Sequence
  Description of Artificial Sequence: Synthetic peptide
  XENP024119 vhCDR1
RYWMS

SEQ ID NO: 29404 - protein, 17 aa, Artificial Sequence
  Description of Artificial Sequence: Synthetic peptide
  XENP024119 vhCDR2
NIKQDGSEKYYVDSVKG

SEQ ID NO: 29405 - protein, 12 aa, Artificial Sequence
  Description of Artificial Sequence: Synthetic peptide
  XENP024119 vhCDR3
EGGWFGELAFDY

SEQ ID NO: 29406 - protein, 450 aa, Artificial Sequence; identical to SEQ ID NO: 27526
  Description of Artificial Sequence: Synthetic polypeptide
  XENP024119 Full length HC

SEQ ID NO: 29407 - protein, 108 aa, Artificial Sequence; identical to SEQ ID NO: 3965
  Description of Artificial Sequence: Synthetic polypeptide
  VL of XENP024119

SEQ ID NO: 29408 - protein, 12 aa, Artificial Sequence
  Description of Artificial Sequence: Synthetic peptide
  XENP024119 vlCDR1
RASQRVSSSYLA

SEQ ID NO: 29409 - protein, 7 aa, Artificial Sequence
  Description of Artificial Sequence: Synthetic peptide
  XENP024119 vlCDR2
DASSRAT

SEQ ID NO: 29410 - protein, 9 aa, Artificial Sequence
  Description of Artificial Sequence: Synthetic peptide
  XENP024119 vlCDR3
QQYGSLPWT

SEQ ID NO: 29411 - protein, 215 aa, Artificial Sequence; identical to SEQ ID NO: 27152
  Description of Artificial Sequence: Synthetic polypeptide
  XENP024119 Full length light chain

SEQ ID NO: 29412 - protein, 121 aa, Artificial Sequence [sequence omitted]

SEQ ID NO: 29413 - protein, 5 aa, Artificial Sequence
  Description of Artificial Sequence: Synthetic peptide
  XENP014410 vhCDR1
GYYWS

SEQ ID NO: 29414 - protein, 16 aa, Artificial Sequence
  Description of Artificial Sequence: Synthetic peptide
  XENP014410 vhCDR2
EINHGGYVTYNPSLES

SEQ ID NO: 29415 - protein, 13 aa, Artificial Sequence
  Description of Artificial Sequence: Synthetic peptide
  XENP014410 vhCDR3
DYGPGNYDWYFDL

SEQ ID NO: 29416 - protein, 450 aa, Artificial Sequence; identical to SEQ ID NO: 26262
  Description of Artificial Sequence: Synthetic polypeptide
  XENP014410 Full length HC

SEQ ID NO: 29417 - protein, 109 aa, Artificial Sequence [sequence omitted]

SEQ ID NO: 29418 - protein, 11 aa, Artificial Sequence
  Description of Artificial Sequence: Synthetic peptide
  XENP014410 vlCDR1
RASQSVSSYLA

SEQ ID NO: 29419 - protein, 7 aa, Artificial Sequence
  Description of Artificial Sequence: Synthetic peptide
  XENP014410 vlCDR2
DASNRAT

SEQ ID NO: 29420 - protein, 11 aa, Artificial Sequence
  Description of Artificial Sequence: Synthetic peptide
  XENP014410 vlCDR3
QQRSNWPPALT

SEQ ID NO: 29421 - protein, 216 aa, Artificial Sequence; identical to SEQ ID NO: 26267
  Description of Artificial Sequence: Synthetic polypeptide
  XENP014410 Full length light chain

SEQ ID NO: 29422 - protein, 118 aa, Artificial Sequence; identical to SEQ ID NO: 26273
  Description of Artificial Sequence: Synthetic polypeptide
  VH of XENP016437

SEQ ID NO: 29423 - protein, 5 aa, Artificial Sequence
  Description of Artificial Sequence: Synthetic peptide
  XENP016437 vhCDR1
SYSMN

SEQ ID NO: 29424 - protein, 17 aa, Artificial Sequence
  Description of Artificial Sequence: Synthetic peptide
  XENP016437 vhCDR2
YISSSSSTIDYADSVKG

SEQ ID NO: 29425 - protein, 9 aa, Artificial Sequence
  Description of Artificial Sequence: Synthetic peptide
  XENP016437 vhCDR3
ESGWYLFDY

SEQ ID NO: 29426 - protein, 447 aa, Artificial Sequence; identical to SEQ ID NO: 26272
  Description of Artificial Sequence: Synthetic polypeptide
  XENP016437 Full length HC

SEQ ID NO: 29427 - protein, 107 aa, Artificial Sequence; identical to SEQ ID NO: 26278
  Description of Artificial Sequence: Synthetic polypeptide
  VL of XENP016437

SEQ ID NO: 29428 - protein, 11 aa, Artificial Sequence
  Description of Artificial Sequence: Synthetic peptide
  XENP016437 vlCDR1
RASQGISSWLA

SEQ ID NO: 29429 - protein, 7 aa, Artificial Sequence
  Description of Artificial Sequence: Synthetic peptide
  XENP016437 vlCDR2
AASSLQS

SEQ ID NO: 29430 - protein, 9 aa, Artificial Sequence
  Description of Artificial Sequence: Synthetic peptide
  XENP016437 vlCDR3
QQYNSYPPT

SEQ ID NO: 29431 - protein, 214 aa, Artificial Sequence; identical to SEQ ID NO: 26277
  Description of Artificial Sequence: Synthetic polypeptide
  XENP016437 Full length light chain

SEQ ID NO: 29432 - protein, 122 aa, Artificial Sequence; identical to SEQ ID NO: 26283
  Description of Artificial Sequence: Synthetic polypeptide
  VH of XENP016438

SEQ ID NO: 29433 - protein, 7 aa, Artificial Sequence
  Description of Artificial Sequence: Synthetic peptide
  XENP016438 vhCDR1
TSGMGVG

SEQ ID NO: 29434 - protein, 16 aa, Artificial Sequence
  Description of Artificial Sequence: Synthetic peptide
  XENP016438 vhCDR2
HIWWDDDKYYSPSLKS

SEQ ID NO: 29435 - protein, 12 aa, Artificial Sequence
  Description of Artificial Sequence: Synthetic peptide
  XENP016438 vhCDR3
SYYYGSSGAMDY

SEQ ID NO: 29436 - protein, 451 aa, Artificial Sequence; identical to SEQ ID NO: 26282
  Description of Artificial Sequence: Synthetic polypeptide
  XENP016438 Full length HC

SEQ ID NO: 29437 - protein, 112 aa, Artificial Sequence; identical to SEQ ID NO: 26288
  Description of Artificial Sequence: Synthetic polypeptide
  VL of XENP016438

SEQ ID NO: 29438 - protein, 16 aa, Artificial Sequence
  Description of Artificial Sequence: Synthetic peptide
  XENP016438 vlCDR1
RSSQSLVHSDGNTYLH

SEQ ID NO: 29439 - protein, 7 aa, Artificial Sequence
  Description of Artificial Sequence: Synthetic peptide
  XENP016438 vlCDR2
KVSKRFS

SEQ ID NO: 29440 - protein, 9 aa, Artificial Sequence
  Description of Artificial Sequence: Synthetic peptide
  XENP016438 vlCDR3
SQSTHVPPT

SEQ ID NO: 29441 - protein, 219 aa, Artificial Sequence; identical to SEQ ID NO: 26287
  Description of Artificial Sequence: Synthetic polypeptide
  XENP016438 Full length light chain

SEQ ID NO: 29442 - protein, 125 aa, Artificial Sequence; identical to SEQ ID NO: 26293
  Description of Artificial Sequence: Synthetic polypeptide
  VH of XENP016435

SEQ ID NO: 29443 - protein, 5 aa, Artificial Sequence
  Description of Artificial Sequence: Synthetic peptide
  XENP016435 vhCDR1
GYYMH

SEQ ID NO: 29444 - protein, 17 aa, Artificial Sequence
  Description of Artificial Sequence: Synthetic peptide
  XENP016435 vhCDR2
WINPHSGGTNYAQKFQG

SEQ ID NO: 29445 - protein, 16 aa, Artificial Sequence
  Description of Artificial Sequence: Synthetic peptide
  XENP016435 vhCDR3
TYYYDSSGYYHDAFDI

SEQ ID NO: 29446 - protein, 454 aa, Artificial Sequence; identical to SEQ ID NO: 26292
  Description of Artificial Sequence: Synthetic polypeptide
  XENP016435 Full length HC

SEQ ID NO: 29447 - protein, 107 aa, Artificial Sequence; identical to SEQ ID NO: 26298
  Description of Artificial Sequence: Synthetic polypeptide
  VL of XENP016435

SEQ ID NO: 29448 - protein, 11 aa, Artificial Sequence
  Description of Artificial Sequence: Synthetic peptide
  XENP016435 vlCDR1
RASQGISRLLA

SEQ ID NO: 29449 - protein, 7 aa, Artificial Sequence
  Description of Artificial Sequence: Synthetic peptide
  XENP016435 vlCDR2
VASSLQS

SEQ ID NO: 29450 - protein, 9 aa, Artificial Sequence
  Description of Artificial Sequence: Synthetic peptide
  XENP016435 vlCDR3
QQANSFPWT

SEQ ID NO: 29451 - protein, 214 aa, Artificial Sequence; identical to SEQ ID NO: 26297
  Description of Artificial Sequence: Synthetic polypeptide
  XENP016435 Full length light chain

SEQ ID NO: 29452 - protein, 123 aa, Artificial Sequence; identical to SEQ ID NO: 26303
  Description of Artificial Sequence: Synthetic polypeptide
  VH of XENP021820

SEQ ID NO: 29453 - protein, 5 aa, Artificial Sequence
  Description of Artificial Sequence: Synthetic peptide
  XENP021820 vhCDR1
TYWMH

SEQ ID NO: 29454 - protein, 17 aa, Artificial Sequence
  Description of Artificial Sequence: Synthetic peptide
  XENP021820 vhCDR2
EIDPSDSYVNYNQNFKG

SEQ ID NO: 29455 - protein, 14 aa, Artificial Sequence
  Description of Artificial Sequence: Synthetic peptide
  XENP021820 vhCDR3
SPDYYGTSLAWFDY

SEQ ID NO: 29456 - protein, 452 aa, Artificial Sequence; identical to SEQ ID NO: 26302
  Description of Artificial Sequence: Synthetic polypeptide
  XENP021820 Full length HC

SEQ ID NO: 29457 - protein, 112 aa, Artificial Sequence; identical to SEQ ID NO: 26308
  Description of Artificial Sequence: Synthetic polypeptide
  VL of XENP021820

SEQ ID NO: 29458 - protein, 16 aa, Artificial Sequence
  Description of Artificial Sequence: Synthetic peptide
  XENP021820 vlCDR1
RSSKSPLHSNGNIYLY

SEQ ID NO: 29459 - protein, 7 aa, Artificial Sequence
  Description of Artificial Sequence: Synthetic peptide
  XENP021820 vlCDR2
RMSNLAS

SEQ ID NO: 29460 - protein, 9 aa, Artificial Sequence
  Description of Artificial Sequence: Synthetic peptide
  XENP021820 vlCDR3
MQHLEYPYT

SEQ ID NO: 29461 - protein, 219 aa, Artificial Sequence; identical to SEQ ID NO: 26307
  Description of Artificial Sequence: Synthetic polypeptide
  XENP021820 Full length light chain

SEQ ID NO: 29462 - protein, 124 aa, Artificial Sequence; identical to SEQ ID NO: 26313
  Description of Artificial Sequence: Synthetic polypeptide
  VH of XENP021821

SEQ ID NO: 29463 - protein, 5 aa, Artificial Sequence
  Description of Artificial Sequence: Synthetic peptide
  XENP021821 vhCDR1
SYWIN

SEQ ID NO: 29464 - protein, 17 aa, Artificial Sequence
  Description of Artificial Sequence: Synthetic peptide
  XENP021821 vhCDR2
NIYPSDSYTNYNQMFKD

SEQ ID NO: 29465 - protein, 15 aa, Artificial Sequence
  Description of Artificial Sequence: Synthetic peptide
  XENP021821 vhCDR3
WNLSYYFDNNYYLDY

SEQ ID NO: 29466 - protein, 453 aa, Artificial Sequence; identical to SEQ ID NO: 26312
  Description of Artificial Sequence: Synthetic polypeptide
  XENP021821 Full length HC

SEQ ID NO: 29467 - protein, 112 aa, Artificial Sequence; identical to SEQ ID NO: 26318
  Description of Artificial Sequence: Synthetic polypeptide
  VL of XENP021821

SEQ ID NO: 29468 - protein, 16 aa, Artificial Sequence
  Description of Artificial Sequence: Synthetic peptide
  XENP021821 vlCDR1
RSSKSLLHSNGNTYLY

SEQ ID NO: 29469 - protein, 7 aa, Artificial Sequence
  Description of Artificial Sequence: Synthetic peptide
  XENP021821 vlCDR2
RMSNLAS

SEQ ID NO: 29470 - protein, 9 aa, Artificial Sequence
  Description of Artificial Sequence: Synthetic peptide
  XENP021821 vlCDR3
MQHLEYPWT

SEQ ID NO: 29471 - protein, 219 aa, Artificial Sequence; identical to SEQ ID NO: 26317
  Description of Artificial Sequence: Synthetic polypeptide
  XENP021821 Full length light chain

SEQ ID NO: 29472 - protein, 125 aa, Artificial Sequence; identical to SEQ ID NO: 26323
  Description of Artificial Sequence: Synthetic polypeptide
  VH of XENP021822

SEQ ID NO: 29473 - protein, 5 aa, Artificial Sequence
  Description of Artificial Sequence: Synthetic peptide
  XENP021822 vhCDR1
SYDMH

SEQ ID NO: 29474 - protein, 16 aa, Artificial Sequence
  Description of Artificial Sequence: Synthetic peptide
  XENP021822 vhCDR2
AIGTAGDTYYPGSVKG

SEQ ID NO: 29475 - protein, 17 aa, Artificial Sequence
  Description of Artificial Sequence: Synthetic peptide
  XENP021822 vhCDR3
DNRKVTHEHYYYYGMDV

SEQ ID NO: 29476 - protein, 454 aa, Artificial Sequence; identical to SEQ ID NO: 26322
  Description of Artificial Sequence: Synthetic polypeptide
  XENP021822 Full length HC

SEQ ID NO: 29477 - protein, 109 aa, Artificial Sequence; identical to SEQ ID NO: 26328
  Description of Artificial Sequence: Synthetic polypeptide
  VL of XENP021822

SEQ ID NO: 29478 - protein, 12 aa, Artificial Sequence
  Description of Artificial Sequence: Synthetic peptide
  XENP021822 vlCDR1
RASQNIRSSYLA

SEQ ID NO: 29479 - protein, 7 aa, Artificial Sequence
  Description of Artificial Sequence: Synthetic peptide
  XENP021822 vlCDR2
GASSRAT

SEQ ID NO: 29480 - protein, 10 aa, Artificial Sequence
  Description of Artificial Sequence: Synthetic peptide
  XENP021822 vlCDR3
QQFGSSPMCS

SEQ ID NO: 29481 - protein, 216 aa, Artificial Sequence; identical to SEQ ID NO: 26327
  Description of Artificial Sequence: Synthetic polypeptide
  XENP021822 Full length light chain

SEQ ID NO: 29482 - protein, 125 aa, Artificial Sequence; identical to SEQ ID NO: 26333
  Description of Artificial Sequence: Synthetic polypeptide
  VH of XENP021823

SEQ ID NO: 29483 - protein, 5 aa, Artificial Sequence
  Description of Artificial Sequence: Synthetic peptide
  XENP021823 vhCDR1
SYDMH

SEQ ID NO: 29484 - protein, 16 aa, Artificial Sequence
  Description of Artificial Sequence: Synthetic peptide
  XENP021823 vhCDR2
AIGTAGDTYYPGSVKG

SEQ ID NO: 29485 - protein, 17 aa, Artificial Sequence
  Description of Artificial Sequence: Synthetic peptide
  XENP021823 vhCDR3
DKRTVTHEHYYYYGMDV

SEQ ID NO: 29486 - protein, 454 aa, Artificial Sequence; identical to SEQ ID NO: 26332
  Description of Artificial Sequence: Synthetic polypeptide
  XENP021823 Full length HC

SEQ ID NO: 29487 - protein, 109 aa, Artificial Sequence; identical to SEQ ID NO: 26338
  Description of Artificial Sequence: Synthetic polypeptide
  VL of XENP021823

SEQ ID NO: 29488 - protein, 12 aa, Artificial Sequence
  Description of Artificial Sequence: Synthetic peptide
  XENP021823 vlCDR1
RASQSISSSSLA

SEQ ID NO: 29489 - protein, 7 aa, Artificial Sequence
  Description of Artificial Sequence: Synthetic peptide
  XENP021823 vlCDR2
GASSRAT

SEQ ID NO: 29490 - protein, 10 aa, Artificial Sequence
  Description of Artificial Sequence: Synthetic peptide
  XENP021823 vlCDR3
QQFGSSPMCS

SEQ ID NO: 29491 - protein, 216 aa, Artificial Sequence; identical to SEQ ID NO: 26337
  Description of Artificial Sequence: Synthetic polypeptide
  XENP021823 Full length light chain

SEQ ID NO: 29492 - protein, 121 aa, Artificial Sequence; identical to SEQ ID NO: 26343
  Description of Artificial Sequence: Synthetic polypeptide
  VH of XENP022346

SEQ ID NO: 29493 - protein, 5 aa, Artificial Sequence
  Description of Artificial Sequence: Synthetic peptide
  XENP022346 vhCDR1
DYAMH

SEQ ID NO: 29494 - protein, 17 aa, Artificial Sequence
  Description of Artificial Sequence: Synthetic peptide
  XENP022346 vhCDR2
LISIYSDHTNYNQKFQG

SEQ ID NO: 29495 - protein, 12 aa, Artificial Sequence
  Description of Artificial Sequence: Synthetic peptide
  XENP022346 vhCDR3
NNYGNYGWYFDV

SEQ ID NO: 29496 - protein, 450 aa, Artificial Sequence; identical to SEQ ID NO: 26342
  Description of Artificial Sequence: Synthetic polypeptide
  XENP022346 Full length HC

SEQ ID NO: 29497 - protein, 106 aa, Artificial Sequence; identical to SEQ ID NO: 26348
  Description of Artificial Sequence: Synthetic polypeptide
  VL of XENP022346

SEQ ID NO: 29498 - protein, 10 aa, Artificial Sequence
  Description of Artificial Sequence: Synthetic peptide
  XENP022346 vlCDR1
SASSSVSYMH

SEQ ID NO: 29499 - protein, 7 aa, Artificial Sequence
  Description of Artificial Sequence: Synthetic peptide
  XENP022346 vlCDR2
DTSKLAS

SEQ ID NO: 29500 - protein, 9 aa, Artificial Sequence
  Description of Artificial Sequence: Synthetic peptide
  XENP022346 vlCDR3
FQGSGYPYT

SEQ ID NO: 29501 - protein, 213 aa, Artificial Sequence; identical to SEQ ID NO: 26347
  Description of Artificial Sequence: Synthetic polypeptide
  XENP022346 Full length light chain

SEQ ID NO: 29502 - protein, 117 aa, Artificial Sequence; identical to SEQ ID NO: 26353
  Description of Artificial Sequence: Synthetic polypeptide
  VH of XENP023057

SEQ ID NO: 29503 - protein, 5 aa, Artificial Sequence
  Description of Artificial Sequence: Synthetic peptide
  XENP023057 vhCDR1
DYWMD

SEQ ID NO: 29504 - protein, 17 aa, Artificial Sequence
  Description of Artificial Sequence: Synthetic peptide
  XENP023057 vhCDR2
NIDEDGSITEYSPFVKG

SEQ ID NO: 29505 - protein, 8 aa, Artificial Sequence
  Description of Artificial Sequence: Synthetic peptide
  XENP023057 vhCDR3
WGRFGFDS

SEQ ID NO: 29506 - protein, 446 aa, Artificial Sequence; identical to SEQ ID NO: 26352
  Description of Artificial Sequence: Synthetic polypeptide
  XENP023057 Full length HC

SEQ ID NO: 29507 - protein, 111 aa, Artificial Sequence; identical to SEQ ID NO: 26358
  Description of Artificial Sequence: Synthetic polypeptide
  VL of XENP023057

SEQ ID NO: 29508 - protein, 15 aa, Artificial Sequence
  Description of Artificial Sequence: Synthetic peptide
  XENP023057 vlCDR1
KSSQSLLSGSFNYLT

SEQ ID NO: 29509 - protein, 7 aa, Artificial Sequence
  Description of Artificial Sequence: Synthetic peptide
  XENP023057 vlCDR2
YASTRHT

SEQ ID NO: 29510 - protein, 9 aa, Artificial Sequence
  Description of Artificial Sequence: Synthetic peptide
  XENP023057 vlCDR3
HHHYNAPPT

SEQ ID NO: 29511 - protein, 218 aa, Artificial Sequence; identical to SEQ ID NO: 26357
  Description of Artificial Sequence: Synthetic polypeptide
  XENP023057 Full length light chain

SEQ ID NO: 29512 - protein, 125 aa, Artificial Sequence; identical to SEQ ID NO: 26293
  Description of Artificial Sequence: Synthetic polypeptide
  VH of XENP022091

SEQ ID NO: 29513 - protein, 5 aa, Artificial Sequence
  Description of Artificial Sequence: Synthetic peptide
  XENP022091 vhCDR1
GYYMH

SEQ ID NO: 29514 - protein, 17 aa, Artificial Sequence
  Description of Artificial Sequence: Synthetic peptide
  XENP022091 vhCDR2
WINPHSGGTNYAQKFQG

SEQ ID NO: 29515 - protein, 16 aa, Artificial Sequence
  Description of Artificial Sequence: Synthetic peptide
  XENP022091 vhCDR3
TYYYDSSGYYHDAFDI

SEQ ID NO: 29516 - protein, 230 aa, Artificial Sequence; identical to SEQ ID NO: 27869
  Description of Artificial Sequence: Synthetic polypeptide
  XENP022091 Full length HC

SEQ ID NO: 29517 - protein, 107 aa, Artificial Sequence; identical to SEQ ID NO: 26478
  Description of Artificial Sequence: Synthetic polypeptide
  VL of XENP022091

SEQ ID NO: 29518 - protein, 11 aa, Artificial Sequence
  Description of Artificial Sequence: Synthetic peptide
  XENP022091 vlCDR1
RASQGISSYLA

SEQ ID NO: 29519 - protein, 7 aa, Artificial Sequence
  Description of Artificial Sequence: Synthetic peptide
  XENP022091 vlCDR2
VASSLQS

SEQ ID NO: 29520 - protein, 9 aa, Artificial Sequence
  Description of Artificial Sequence: Synthetic peptide
  XENP022091 vlCDR3
QQANSFPWT

SEQ ID NO: 29521 - protein, 214 aa, Artificial Sequence; identical to SEQ ID NO: 26477
  Description of Artificial Sequence: Synthetic polypeptide
  XENP022091 Full length light chain

SEQ ID NO: 29522 - protein, 125 aa, Artificial Sequence; identical to SEQ ID NO: 26293
  Description of Artificial Sequence: Synthetic polypeptide
  VH of XENP022780

SEQ ID NO: 29523 - protein, 5 aa, Artificial Sequence
  Description of Artificial Sequence: Synthetic peptide
  XENP022780 vhCDR1
GYYMH

SEQ ID NO: 29524 - protein, 17 aa, Artificial Sequence
  Description of Artificial Sequence: Synthetic peptide
  XENP022780 vhCDR2
WINPHSGGTNYAQKFQG

SEQ ID NO: 29525 - protein, 16 aa, Artificial Sequence
  Description of Artificial Sequence: Synthetic peptide
  XENP022780 vhCDR3
TYYYDSSGYYHDAFDI

SEQ ID NO: 29526 - protein, 230 aa, Artificial Sequence; identical to SEQ ID NO: 27869
  Description of Artificial Sequence: Synthetic polypeptide
  XENP022780 Full length HC

SEQ ID NO: 29527 - protein, 107 aa, Artificial Sequence; identical to SEQ ID NO: 26498
  Description of Artificial Sequence: Synthetic polypeptide
  VL of XENP022780

SEQ ID NO: 29528 - protein, 11 aa, Artificial Sequence
  Description of Artificial Sequence: Synthetic peptide
  XENP022780 vlCDR1
QASQDISRLLA

SEQ ID NO: 29529 - protein, 7 aa, Artificial Sequence
  Description of Artificial Sequence: Synthetic peptide
  XENP022780 vlCDR2
VASSLQS

SEQ ID NO: 29530 - protein, 9 aa, Artificial Sequence
  Description of Artificial Sequence: Synthetic peptide
  XENP022780 vlCDR3
QQAESFPWT

SEQ ID NO: 29531 - protein, 214 aa, Artificial Sequence; identical to SEQ ID NO: 26497
  Description of Artificial Sequence: Synthetic polypeptide
  XENP022780 Full length light chain

SEQ ID NO: 29532 - protein, 125 aa, Artificial Sequence; identical to SEQ ID NO: 26293
  Description of Artificial Sequence: Synthetic polypeptide
  VH of XENP022782

SEQ ID NO: 29533 - protein, 5 aa, Artificial Sequence
  Description of Artificial Sequence: Synthetic peptide
  XENP022782 vhCDR1
GYYMH

SEQ ID NO: 29534 - protein, 17 aa, Artificial Sequence
  Description of Artificial Sequence: Synthetic peptide
  XENP022782 vhCDR2
WINPHSGGTNYAQKFQG

SEQ ID NO: 29535 - protein, 16 aa, Artificial Sequence
  Description of Artificial Sequence: Synthetic peptide
  XENP022782 vhCDR3
TYYYDSSGYYHDAFDI

SEQ ID NO: 29536 - protein, 230 aa, Artificial Sequence; identical to SEQ ID NO: 27869
  Description of Artificial Sequence: Synthetic polypeptide
  XENP022782 Full length HC

SEQ ID NO: 29537 - protein, 107 aa, Artificial Sequence; identical to SEQ ID NO: 26518
  Description of Artificial Sequence: Synthetic polypeptide
  VL of XENP022782

SEQ ID NO: 29538 - protein, 11 aa, Artificial Sequence
  Description of Artificial Sequence: Synthetic peptide
  XENP022782 vlCDR1
QASQDISSLLA

SEQ ID NO: 29539 - protein, 7 aa, Artificial Sequence
  Description of Artificial Sequence: Synthetic peptide
  XENP022782 vlCDR2
VASSLQS

SEQ ID NO: 29540 - protein, 9 aa, Artificial Sequence
  Description of Artificial Sequence: Synthetic peptide
  XENP022782 vlCDR3
QQAESFPWT

SEQ ID NO: 29541 - protein, 214 aa, Artificial Sequence; identical to SEQ ID NO: 26517
  Description of Artificial Sequence: Synthetic polypeptide
  XENP022782 Full length light chain

SEQ ID NO: 29542 - protein, 125 aa, Artificial Sequence; identical to SEQ ID NO: 26293
  Description of Artificial Sequence: Synthetic polypeptide
  VH of XENP022783

SEQ ID NO: 29543 - protein, 5 aa, Artificial Sequence
  Description of Artificial Sequence: Synthetic peptide
  XENP022783 vhCDR1
GYYMH

SEQ ID NO: 29544 - protein, 17 aa, Artificial Sequence
  Description of Artificial Sequence: Synthetic peptide
  XENP022783 vhCDR2
WINPHSGGTNYAQKFQG

SEQ ID NO: 29545 - protein, 16 aa, Artificial Sequence
  Description of Artificial Sequence: Synthetic peptide
  XENP022783 vhCDR3
TYYYDSSGYYHDAFDI

SEQ ID NO: 29546 - protein, 230 aa, Artificial Sequence; identical to SEQ ID NO: 27869
  Description of Artificial Sequence: Synthetic polypeptide
  XENP022783 Full length HC

SEQ ID NO: 29547 - protein, 107 aa, Artificial Sequence; identical to SEQ ID NO: 26538
  Description of Artificial Sequence: Synthetic polypeptide
  VL of XENP022783

SEQ ID NO: 29548 - protein, 11 aa, Artificial Sequence
  Description of Artificial Sequence: Synthetic peptide
  XENP022783 vlCDR1
QASQDISRLLA

SEQ ID NO: 29549 - protein, 7 aa, Artificial Sequence
  Description of Artificial Sequence: Synthetic peptide
  XENP022783 vlCDR2
AASSLQS

SEQ ID NO: 29550 - protein, 9 aa, Artificial Sequence
  Description of Artificial Sequence: Synthetic peptide
  XENP022783 vlCDR3
QQAESFPWT

SEQ ID NO: 29551 - protein, 214 aa, Artificial Sequence; identical to SEQ ID NO: 26537
  Description of Artificial Sequence: Synthetic polypeptide
  XENP022783 Full length light chain

SEQ ID NO: 29552 - protein, 125 aa, Artificial Sequence; identical to SEQ ID NO: 26293
  Description of Artificial Sequence: Synthetic polypeptide
  VH of XENP022784

SEQ ID NO: 29553 - protein, 5 aa, Artificial Sequence
  Description of Artificial Sequence: Synthetic peptide
  XENP022784 vhCDR1
GYYMH

SEQ ID NO: 29554 - protein, 17 aa, Artificial Sequence
  Description of Artificial Sequence: Synthetic peptide
  XENP022784 vhCDR2
WINPHSGGTNYAQKFQG

SEQ ID NO: 29555 - protein, 16 aa, Artificial Sequence
  Description of Artificial Sequence: Synthetic peptide
  XENP022784 vhCDR3
TYYYDSSGYYHDAFDI

SEQ ID NO: 29556 - protein, 230 aa, Artificial Sequence; identical to SEQ ID NO: 27869
  Description of Artificial Sequence: Synthetic polypeptide
  XENP022784 Full length HC

SEQ ID NO: 29557 - protein, 107 aa, Artificial Sequence; identical to SEQ ID NO: 26558
  Description of Artificial Sequence: Synthetic polypeptide
  VL of XENP022784

SEQ ID NO: 29558 - protein, 11 aa, Artificial Sequence
  Description of Artificial Sequence: Synthetic peptide
  XENP022784 vlCDR1
QASQDISSLLA

SEQ ID NO: 29559 - protein, 7 aa, Artificial Sequence
  Description of Artificial Sequence: Synthetic peptide
  XENP022784 vlCDR2
AASSLQS

SEQ ID NO: 29560 - protein, 9 aa, Artificial Sequence
  Description of Artificial Sequence: Synthetic peptide
  XENP022784 vlCDR3
QQAESFPWT

SEQ ID NO: 29561 - protein, 214 aa, Artificial Sequence; identical to SEQ ID NO: 26557
  Description of Artificial Sequence: Synthetic polypeptide
  XENP022784 Full length light chain

SEQ ID NO: 29562 - protein, 125 aa, Artificial Sequence; identical to SEQ ID NO: 26563
  Description of Artificial Sequence: Synthetic polypeptide
  VH of XENP023088

SEQ ID NO: 29563 - protein, 5 aa, Artificial Sequence
  Description of Artificial Sequence: Synthetic peptide
  XENP023088 vhCDR1
GYYMH

SEQ ID NO: 29564 - protein, 17 aa, Artificial Sequence
  Description of Artificial Sequence: Synthetic peptide
  XENP023088 vhCDR2
WINPHSGETIYAQKFQG

SEQ ID NO: 29565 - protein, 16 aa, Artificial Sequence
  Description of Artificial Sequence: Synthetic peptide
  XENP023088 vhCDR3
TYYYDTSGYYHDAFDV

SEQ ID NO: 29566 - protein, 230 aa, Artificial Sequence; identical to SEQ ID NO: 28081
  Description of Artificial Sequence: Synthetic polypeptide
  XENP023088 Full length HC

SEQ ID NO: 29567 - protein, 107 aa, Artificial Sequence; identical to SEQ ID NO: 26298
  Description of Artificial Sequence: Synthetic polypeptide
  VL of XENP023088

SEQ ID NO: 29568 - protein, 11 aa, Artificial Sequence
  Description of Artificial Sequence: Synthetic peptide
  XENP023088 vlCDR1
RASQGISRLLA

SEQ ID NO: 29569 - protein, 7 aa, Artificial Sequence
  Description of Artificial Sequence: Synthetic peptide
  XENP023088 vlCDR2
VASSLQS

SEQ ID NO: 29570 - protein, 9 aa, Artificial Sequence
  Description of Artificial Sequence: Synthetic peptide
  XENP023088 vlCDR3
QQANSFPWT

SEQ ID NO: 29571 - protein, 214 aa, Artificial Sequence; identical to SEQ ID NO: 26297
  Description of Artificial Sequence: Synthetic polypeptide
  XENP023088 Full length light chain

SEQ ID NO: 29572 - protein, 125 aa, Artificial Sequence; identical to SEQ ID NO: 26563
  Description of Artificial Sequence: Synthetic polypeptide
  VH of XENP023409

SEQ ID NO: 29573 - protein, 5 aa, Artificial Sequence
  Description of Artificial Sequence: Synthetic peptide
  XENP023409 vhCDR1
GYYMH

SEQ ID NO: 29574 - protein, 17 aa, Artificial Sequence
  Description of Artificial Sequence: Synthetic peptide
  XENP023409 vhCDR2
WINPHSGETIYAQKFQG

SEQ ID NO: 29575 - protein, 16 aa, Artificial Sequence
  Description of Artificial Sequence: Synthetic peptide
  XENP023409 vhCDR3
TYYYDTSGYYHDAFDV

SEQ ID NO: 29576 - protein, 230 aa, Artificial Sequence; identical to SEQ ID NO: 28081
  Description of Artificial Sequence: Synthetic polypeptide
  XENP023409 Full length HC

SEQ ID NO: 29577 - protein, 107 aa, Artificial Sequence; identical to SEQ ID NO: 26498
  Description of Artificial Sequence: Synthetic polypeptide
  VL of XENP023409

SEQ ID NO: 29578 - protein, 11 aa, Artificial Sequence
  Description of Artificial Sequence: Synthetic peptide
  XENP023409 vlCDR1
QASQDISRLLA

SEQ ID NO: 29579 - protein, 7 aa, Artificial Sequence
  Description of Artificial Sequence: Synthetic peptide
  XENP023409 vlCDR2
VASSLQS

SEQ ID NO: 29580 - protein, 9 aa, Artificial Sequence
  Description of Artificial Sequence: Synthetic peptide
  XENP023409 vlCDR3
QQAESFPWT

SEQ ID NO: 29581 - protein, 214 aa, Artificial Sequence; identical to SEQ ID NO: 26497
  Description of Artificial Sequence: Synthetic polypeptide
  XENP023409 Full length light chain

SEQ ID NO: 29582 - protein, 125 aa, Artificial Sequence; identical to SEQ ID NO: 26293
  Description of Artificial Sequence: Synthetic polypeptide
  VH of XENP024352

SEQ ID NO: 29583 - protein, 5 aa, Artificial Sequence
  Description of Artificial Sequence: Synthetic peptide
  XENP024352 vhCDR1
GYYMH

SEQ ID NO: 29584 - protein, 17 aa, Artificial Sequence
  Description of Artificial Sequence: Synthetic peptide
  XENP024352 vhCDR2
WINPHSGGTNYAQKFQG

SEQ ID NO: 29585 - protein, 16 aa, Artificial Sequence
  Description of Artificial Sequence: Synthetic peptide
  XENP024352 vhCDR3
TYYYDSSGYYHDAFDI

SEQ ID NO: 29586 - protein, 20 aa, Artificial Sequence
  Description of Artificial Sequence: Synthetic peptide
  XENP024352 scFv linker
GKPGSGKPGSGKPGSGKPGS

SEQ ID NO: 29587 - protein, 107 aa, Artificial Sequence; identical to SEQ ID NO: 26298
  Description of Artificial Sequence: Synthetic polypeptide
  VL of XENP024352

SEQ ID NO: 29588 - protein, 11 aa, Artificial Sequence
  Description of Artificial Sequence: Synthetic peptide
  XENP024352 vlCDR1
RASQGISRLLA

SEQ ID NO: 29589 - protein, 7 aa, Artificial Sequence
  Description of Artificial Sequence: Synthetic peptide
  XENP024352 vlCDR2
VASSLQS

SEQ ID NO: 29590 - protein, 9 aa, Artificial Sequence
  Description of Artificial Sequence: Synthetic peptide
  XENP024352 vlCDR3
QQANSFPWT

SEQ ID NO: 29591 - protein, 254 aa, Artificial Sequence
  Description of Artificial Sequence: Synthetic polypeptide
  XENP024352 scFv
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGKPGSGKPGSGKPGSGKPGSDIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKGS

SEQ ID NO: 29592 - protein, 125 aa, Artificial Sequence; identical to SEQ ID NO: 26293
  Description of Artificial Sequence: Synthetic polypeptide
  VH of XENP024353

SEQ ID NO: 29593 - protein, 5 aa, Artificial Sequence
  Description of Artificial Sequence: Synthetic peptide
  XENP024353 vhCDR1
GYYMH

SEQ ID NO: 29594 - protein, 17 aa, Artificial Sequence
  Description of Artificial Sequence: Synthetic peptide
  XENP024353 vhCDR2
WINPHSGGTNYAQKFQG

SEQ ID NO: 29595 - protein, 16 aa, Artificial Sequence
  Description of Artificial Sequence: Synthetic peptide
  XENP024353 vhCDR3
TYYYDSSGYYHDAFDI

SEQ ID NO: 29596 - protein, 20 aa, Artificial Sequence
  Description of Artificial Sequence: Synthetic peptide
  XENP024353 scFv linker
GKPGSGKPGSGKPGSGKPGS

SEQ ID NO: 29597 - protein, 107 aa, Artificial Sequence; identical to SEQ ID NO: 26298
  Description of Artificial Sequence: Synthetic polypeptide
  VL of XENP024353

SEQ ID NO: 29598 - protein, 11 aa, Artificial Sequence
  Description of Artificial Sequence: Synthetic peptide
  XENP024353 vlCDR1
RASQGISRLLA

SEQ ID NO: 29599 - protein, 7 aa, Artificial Sequence
  Description of Artificial Sequence: Synthetic peptide
  XENP024353 vlCDR2
VASSLQS

SEQ ID NO: 29600 - protein, 9 aa, Artificial Sequence
  Description of Artificial Sequence: Synthetic peptide
  XENP024353 vlCDR3
QQANSFPWT

SEQ ID NO: 29601 - protein, 254 aa, Artificial Sequence
  Description of Artificial Sequence: Synthetic polypeptide
  XENP024353 scFv
DIQMTQSPSSVSASVGDRVTITCRASQGISRLLAWYQQKPGKAPKLLIYVASSLQSGVPSRFSGSGSGTDFTLTISSLQPEDFATYYCQQANSFPWTFGQGTKVEIKGKPGSGKPGSGKPGSGKPGSQVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDIWGQGTMVTVSSGS

SEQ ID NO: 29602 - protein, 125 aa, Artificial Sequence
  Description of Artificial Sequence: Synthetic polypeptide
  VH of XENP024354
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSS

SEQ ID NO: 29603 - protein, 5 aa, Artificial Sequence
  Description of Artificial Sequence: Synthetic peptide
  XENP024354 vhCDR1
GYYMH

SEQ ID NO: 29604 - protein, 17 aa, Artificial Sequence
  Description of Artificial Sequence: Synthetic peptide
  XENP024354 vhCDR2
WINPHSGETNYAQKFQG

SEQ ID NO: 29605 - protein, 16 aa, Artificial Sequence
  Description of Artificial Sequence: Synthetic peptide
  XENP024354 vhCDR3
TYYYDTSGYYHDAFDV

SEQ ID NO: 29606 - protein, 20 aa, Artificial Sequence
  Description of Artificial Sequence: Synthetic peptide
  XENP024354 scFv linker
GKPGSGKPGSGKPGSGKPGS

SEQ ID NO: 29607 - protein, 107 aa, Artificial Sequence
  Description of Artificial Sequence: Synthetic polypeptide
  VL of XENP024354
DIQMTQSPSSVSASVGDRVTITCRASQDISRLLAWYQQKPGKAPKLLIYAASSLQSGVPSRFSGSGSGTDFTLTISSLQPEDFATYYCQQANSFPWTFGQGTKVEIK

SEQ ID NO: 29608 - protein, 11 aa, Artificial Sequence
  Description of Artificial Sequence: Synthetic peptide
  XENP024354 vlCDR1
RASQDISRLLA

SEQ ID NO: 29609 - protein, 7 aa, Artificial Sequence
  Description of Artificial Sequence: Synthetic peptide
  XENP024354 vlCDR2
AASSLQS

SEQ ID NO: 29610 - protein, 9 aa, Artificial Sequence
  Description of Artificial Sequence: Synthetic peptide
  XENP024354 vlCDR3
QQANSFPWT

SEQ ID NO: 29611 - protein, 254 aa, Artificial Sequence
  Description of Artificial Sequence: Synthetic polypeptide
  XENP024354 scFv
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQANSFPWTFGQGTKVEIKGS

SEQ ID NO: 29612 - protein, 125 aa, Artificial Sequence; identical to SEQ ID NO: 29602
  Description of Artificial Sequence: Synthetic polypeptide
  VH of XENP024355

SEQ ID NO: 29613 - protein, 5 aa, Artificial Sequence
  Description of Artificial Sequence: Synthetic peptide
  XENP024355 vhCDR1
GYYMH

SEQ ID NO: 29614 - protein, 17 aa, Artificial Sequence
  Description of Artificial Sequence: Synthetic peptide
  XENP024355 vhCDR2
WINPHSGETNYAQKFQG

SEQ ID NO: 29615 - protein, 16 aa, Artificial Sequence
  Description of Artificial Sequence: Synthetic peptide
  XENP024355 vhCDR3
TYYYDTSGYYHDAFDV

SEQ ID NO: 29616 - protein, 20 aa, Artificial Sequence
  Description of Artificial Sequence: Synthetic peptide
  XENP024355 scFv linker
GKPGSGKPGSGKPGSGKPGS

SEQ ID NO: 29617 - protein, 107 aa, Artificial Sequence
  Description of Artificial Sequence: Synthetic polypeptide
  VL of XENP024355
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIK

SEQ ID NO: 29618 - protein, 11 aa, Artificial Sequence
  Description of Artificial Sequence: Synthetic peptide
  XENP024355 vlCDR1
RASQDISRLLA

SEQ ID NO: 29619 - protein, 7 aa, Artificial Sequence
  Description of Artificial Sequence: Synthetic peptide
  XENP024355 vlCDR2
AASSLQS

SEQ ID NO: 29620 - protein, 9 aa, Artificial Sequence
  Description of Artificial Sequence: Synthetic peptide
  XENP024355 vlCDR3
QQAQSFPWT

SEQ ID NO: 29621 - protein, 254 aa, Artificial Sequence
  Description of Artificial Sequence: Synthetic polypeptide
  XENP024355 scFv
QVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGS

SEQ ID NO: 29622 - protein, 125 aa, Artificial Sequence; identical to SEQ ID NO: 26563
  Description of Artificial Sequence: Synthetic polypeptide
  VH of XENP024356

SEQ ID NO: 29623 - protein, 5 aa, Artificial Sequence
  Description of Artificial Sequence: Synthetic peptide
  XENP024356 vhCDR1
GYYMH

SEQ ID NO: 29624 - protein, 17 aa, Artificial Sequence
  Description of Artificial Sequence: Synthetic peptide
  XENP024356 vhCDR2
WINPHSGETIYAQKFQG

SEQ ID NO: 29625 - protein, 16 aa, Artificial Sequence
  Description of Artificial Sequence: Synthetic peptide
  XENP024356 vhCDR3
TYYYDTSGYYHDAFDV

SEQ ID NO: 29626 - protein, 20 aa, Artificial Sequence
  Description of Artificial Sequence: Synthetic peptide
  XENP024356 scFv linker
GKPGSGKPGSGKPGSGKPGS

SEQ ID NO: 29627 - protein, 107 aa, Artificial Sequence; identical to SEQ ID NO: 29607
  Description of Artificial Sequence: Synthetic polypeptide
  VL of XENP024356

SEQ ID NO: 29628 - protein, 11 aa, Artificial Sequence
  Description of Artificial Sequence: Synthetic peptide
  XENP024356 vlCDR1
RASQDISRLLA

SEQ ID NO: 29629 - protein, 7 aa, Artificial Sequence
  Description of Artificial Sequence: Synthetic peptide
  XENP024356 vlCDR2
AASSLQS

SEQ ID NO: 29630 - protein, 9 aa, Artificial Sequence
  Description of Artificial Sequence: Synthetic peptide
  XENP024356 vlCDR3
QQANSFPWT

SEQ ID NO: 29631 - protein, 254 aa, Artificial Sequence
  Description of Artificial Sequence: Synthetic polypeptide
  XENP024356 scFv
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQANSFPWTFGQGTKVEIKGS

SEQ ID NO: 29632 - protein, 125 aa, Artificial Sequence; identical to SEQ ID NO: 26563
  Description of Artificial Sequence: Synthetic polypeptide
  VH of XENP024357

SEQ ID NO: 29633 - protein, 5 aa, Artificial Sequence
  Description of Artificial Sequence: Synthetic peptide
  XENP024357 vhCDR1
GYYMH

SEQ ID NO: 29634 - protein, 17 aa, Artificial Sequence
  Description of Artificial Sequence: Synthetic peptide
  XENP024357 vhCDR2
WINPHSGETIYAQKFQG

SEQ ID NO: 29635 - protein, 16 aa, Artificial Sequence
  Description of Artificial Sequence: Synthetic peptide
  XENP024357 vhCDR3
TYYYDTSGYYHDAFDV

SEQ ID NO: 29636 - protein, 20 aa, Artificial Sequence
  Description of Artificial Sequence: Synthetic peptide
  XENP024357 scFv linker
GKPGSGKPGSGKPGSGKPGS

SEQ ID NO: 29637 - protein, 107 aa, Artificial Sequence; identical to SEQ ID NO: 29617
  Description of Artificial Sequence: Synthetic polypeptide
  VL of XENP024357

SEQ ID NO: 29638 - protein, 11 aa, Artificial Sequence
  Description of Artificial Sequence: Synthetic peptide
  XENP024357 vlCDR1
RASQDISRLLA

SEQ ID NO: 29639 - protein, 7 aa, Artificial Sequence
  Description of Artificial Sequence: Synthetic peptide
  XENP024357 vlCDR2
AASSLQS

SEQ ID NO: 29640 - protein, 9 aa, Artificial Sequence
  Description of Artificial Sequence: Synthetic peptide
  XENP024357 vlCDR3
QQAQSFPWT

SEQ ID NO: 29641 - protein, 254 aa, Artificial Sequence
  Description of Artificial Sequence: Synthetic polypeptide
  XENP024357 scFv
QVQLVQSGAEVKKPGASVKVSCKASGYTFTGYYMHWVRQAPGQGLEWMGWINPHSGETIYAQKFQGRVTMTRDTSISTAYMELSSLRSEDTAVYYCARTYYYDTSGYYHDAFDVWGQGTMVTVSSGKPGSGKPGSGKPGSGKPGSDIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGS

SEQ ID NO: 29642 - protein, 125 aa, Artificial Sequence; identical to SEQ ID NO: 29602
  Description of Artificial Sequence: Synthetic polypeptide
  VH of XENP024609

SEQ ID NO: 29643 - protein, 5 aa, Artificial Sequence
  Description of Artificial Sequence: Synthetic peptide
  XENP024609 vhCDR1
GYYMH

SEQ ID NO: 29644 - protein, 17 aa, Artificial Sequence
  Description of Artificial Sequence: Synthetic peptide
  XENP024609 vhCDR2
WINPHSGETNYAQKFQG

SEQ ID NO: 29645 - protein, 16 aa, Artificial Sequence
  Description of Artificial Sequence: Synthetic peptide
  XENP024609 vhCDR3
TYYYDTSGYYHDAFDV

SEQ ID NO: 29646 - protein, 20 aa, Artificial Sequence
  Description of Artificial Sequence: Synthetic peptide
  XENP024609 scFv linker
GKPGSGKPGSGKPGSGKPGS

SEQ ID NO: 29647 - protein, 107 aa, Artificial Sequence; identical to SEQ ID NO: 29617
  Description of Artificial Sequence: Synthetic polypeptide
  VL of XENP024609

SEQ ID NO: 29648 - protein, 11 aa, Artificial Sequence
  Description of Artificial Sequence: Synthetic peptide
  XENP024609 vlCDR1
RASQDISRLLA

SEQ ID NO: 29649 - protein, 7 aa, Artificial Sequence
  Description of Artificial Sequence: Synthetic peptide
  XENP024609 vlCDR2
AASSLQS

SEQ ID NO: 29650 - protein, 9 aa, Artificial Sequence
  Description of Artificial Sequence: Synthetic peptide
  XENP024609 vlCDR3
QQAQSFPWT

SEQ ID NO: 29651 - protein, 254 aa, Artificial Sequence
  Description of Artificial Sequence: Synthetic polypeptide
  XENP024609 scFv
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGS

SEQ ID NO: 29652 - protein, 125 aa, Artificial Sequence
  Description of Artificial Sequence: Synthetic polypeptide
  VH of XENP024689
QVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSS

SEQ ID NO: 29653 - protein, 5 aa, Artificial Sequence
  Description of Artificial Sequence: Synthetic peptide
  XENP024689 vhCDR1
GYYMH

SEQ ID NO: 29654 - protein, 17 aa, Artificial Sequence
  Description of Artificial Sequence: Synthetic peptide
  XENP024689 vhCDR2
WINPHSGGTNYAQKFQG

SEQ ID NO: 29655 - protein, 16 aa, Artificial Sequence
  Description of Artificial Sequence: Synthetic peptide
  XENP024689 vhCDR3
TYYYDTSGYYHDAFDV

SEQ ID NO: 29656 - protein, 20 aa, Artificial Sequence
  Description of Artificial Sequence: Synthetic peptide
  XENP024689 scFv linker
GKPGSGKPGSGKPGSGKPGS

SEQ ID NO: 29657 - protein, 107 aa, Artificial Sequence; identical to SEQ ID NO: 29617
  Description of Artificial Sequence: Synthetic polypeptide
  VL of XENP024689

SEQ ID NO: 29658 - protein, 11 aa, Artificial Sequence
  Description of Artificial Sequence: Synthetic peptide
  XENP024689 vlCDR1
RASQDISRLLA

SEQ ID NO: 29659 - protein, 7 aa, Artificial Sequence
  Description of Artificial Sequence: Synthetic peptide
  XENP024689 vlCDR2
AASSLQS

SEQ ID NO: 29660 - protein, 9 aa, Artificial Sequence
  Description of Artificial Sequence: Synthetic peptide
  XENP024689 vlCDR3
QQAQSFPWT

SEQ ID NO: 29661 - protein, 254 aa, Artificial Sequence
  Description of Artificial Sequence: Synthetic polypeptide
  XENP024689 scFv
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGGTNYAQKFQGRVTMTRDTSISTAYMELSSLRSEDTAVYYCARTYYYDTSGYYHDAFDVWGQGTMVTVSSGS

SEQ ID NO: 29662 - protein, 125 aa, Artificial Sequence
  Description of Artificial Sequence: Synthetic polypeptide
  VH of XENP024690
QVQLVQSGAEVKKPGASVKVSCKASGYTFTGYYMHWVRQAPGQGLEWMGWINPHSGETNYAQKFQGRVTMTRDTSISTAYMELSRLRSDDTAVYYCARTYYYDTSGYYHDAFDVWGQGTMVTVSS

SEQ ID NO: 29663 - protein, 5 aa, Artificial Sequence
  Description of Artificial Sequence: Synthetic peptide
  XENP024690 vhCDR1
GYYMH

SEQ ID NO: 29664 - protein, 17 aa, Artificial Sequence
  Description of Artificial Sequence: Synthetic peptide
  XENP024690 vhCDR2
WINPHSGETNYAQKFQG

SEQ ID NO: 29665 - protein, 16 aa, Artificial Sequence
  Description of Artificial Sequence: Synthetic peptide
  XENP024690 vhCDR3
TYYYDTSGYYHDAFDV

SEQ ID NO: 29666 - protein, 20 aa, Artificial Sequence
  Description of Artificial Sequence: Synthetic peptide
  XENP024690 scFv linker
GKPGSGKPGSGKPGSGKPGS

SEQ ID NO: 29667 - protein, 107 aa, Artificial Sequence; identical to SEQ ID NO: 29617
  Description of Artificial Sequence: Synthetic polypeptide
  VL of XENP024690

SEQ ID NO: 29668 - protein, 11 aa, Artificial Sequence
  Description of Artificial Sequence: Synthetic peptide
  XENP024690 vlCDR1
RASQDISRLLA

SEQ ID NO: 29669 - protein, 7 aa, Artificial Sequence
  Description of Artificial Sequence: Synthetic peptide
  XENP024690 vlCDR2
AASSLQS

SEQ ID NO: 29670 - protein, 9 aa, Artificial Sequence
  Description of Artificial Sequence: Synthetic peptide
  XENP024690 vlCDR3
QQAQSFPWT

SEQ ID NO: 29671 - protein, 254 aa, Artificial Sequence
  Description of Artificial Sequence: Synthetic polypeptide
  XENP024690 scFv
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGETNYAQKFQGRVTMTRDTSISTAYMELSRLRSDDTAVYYCARTYYYDTSGYYHDAFDVWGQGTMVTVSSGS

SEQ ID NO: 29672 - protein, 125 aa, Artificial Sequence
  Description of Artificial Sequence: Synthetic polypeptide
  VH of XENP024691
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSS

SEQ ID NO: 29673 - protein, 5 aa, Artificial Sequence
  Description of Artificial Sequence: Synthetic peptide
  XENP024691 vhCDR1
GYYMH

SEQ ID NO: 29674 - protein, 17 aa, Artificial Sequence
  Description of Artificial Sequence: Synthetic peptide
  XENP024691 vhCDR2
WINPHSGGTNYAQKFQG

SEQ ID NO: 29675 - protein, 16 aa, Artificial Sequence
  Description of Artificial Sequence: Synthetic peptide
  XENP024691 vhCDR3
TYYYDTSGYYHDAFDV

SEQ ID NO: 29676 - protein, 20 aa, Artificial Sequence
  Description of Artificial Sequence: Synthetic peptide
  XENP024691 scFv linker
GKPGSGKPGSGKPGSGKPGS

SEQ ID NO: 29677 - protein, 107 aa, Artificial Sequence; identical to SEQ ID NO: 29617
  Description of Artificial Sequence: Synthetic polypeptide
  VL of XENP024691

SEQ ID NO: 29678 - protein, 11 aa, Artificial Sequence
  Description of Artificial Sequence: Synthetic peptide
  XENP024691 vlCDR1
RASQDISRLLA

SEQ ID NO: 29679 - protein, 7 aa, Artificial Sequence
  Description of Artificial Sequence: Synthetic peptide
  XENP024691 vlCDR2
AASSLQS

SEQ ID NO: 29680 - protein, 9 aa, Artificial Sequence
  Description of Artificial Sequence: Synthetic peptide
  XENP024691 vlCDR3
QQAQSFPWT

SEQ ID NO: 29681 - protein, 254 aa, Artificial Sequence
  Description of Artificial Sequence: Synthetic polypeptide
  XENP024691 scFv
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDTSGYYHDAFDVWGQGTMVTVSSGS

SEQ ID NO: 29682 - protein, 125 aa, Artificial Sequence
  Description of Artificial Sequence: Synthetic polypeptide
  VH of XENP024692
QVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDVWGQGTMVTVSS

SEQ ID NO: 29683 - protein, 5 aa, Artificial Sequence
  Description of Artificial Sequence: Synthetic peptide
  XENP024692 vhCDR1
GYYMH

SEQ ID NO: 29684 - protein, 17 aa, Artificial Sequence
  Description of Artificial Sequence: Synthetic peptide
  XENP024692 vhCDR2
WINPHSGGTNYAQKFQG

SEQ ID NO: 29685 - protein, 16 aa, Artificial Sequence
  Description of Artificial Sequence: Synthetic peptide
  XENP024692 vhCDR3
TYYYDSSGYYHDAFDV

SEQ ID NO: 29686 - protein, 20 aa, Artificial Sequence
  Description of Artificial Sequence: Synthetic peptide
  XENP024692 scFv linker
GKPGSGKPGSGKPGSGKPGS

SEQ ID NO: 29687 - protein, 107 aa, Artificial Sequence; identical to SEQ ID NO: 29617
  Description of Artificial Sequence: Synthetic polypeptide
  VL of XENP024692

SEQ ID NO: 29688 - protein, 11 aa, Artificial Sequence
  Description of Artificial Sequence: Synthetic peptide
  XENP024692 vlCDR1
RASQDISRLLA

SEQ ID NO: 29689 - protein, 7 aa, Artificial Sequence
  Description of Artificial Sequence: Synthetic peptide
  XENP024692 vlCDR2
AASSLQS

SEQ ID NO: 29690 - protein, 9 aa, Artificial Sequence
  Description of Artificial Sequence: Synthetic peptide
  XENP024692 vlCDR3
QQAQSFPWT

SEQ ID NO: 29691 - protein, 254 aa, Artificial Sequence
  Description of Artificial Sequence: Synthetic polypeptide
  XENP024692 scFv
DIQMTQSPSSVSASVGDRVTITCRASQDISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGGTNYAQKFQGRVTMTRDTSISTAYMELSRLRSDDTAVYYCARTYYYDSSGYYHDAFDVWGQGTMVTVSSGS

SEQ ID NO: 29692 - protein, 125 aa, Artificial Sequence; identical to SEQ ID NO: 29602
  Description of Artificial Sequence: Synthetic polypeptide
  VH of XENP024693

SEQ ID NO: 29693 - protein, 5 aa, Artificial Sequence
  Description of Artificial Sequence: Synthetic peptide
  XENP024693 vhCDR1
GYYMH

SEQ ID NO: 29694 - protein, 17 aa, Artificial Sequence
  Description of Artificial Sequence: Synthetic peptide
  XENP024693 vhCDR2
WINPHSGETNYAQKFQG

SEQ ID NO: 29695 - protein, 16 aa, Artificial Sequence
  Description of Artificial Sequence: Synthetic peptide
  XENP024693 vhCDR3
TYYYDTSGYYHDAFDV

SEQ ID NO: 29696 - protein, 20 aa, Artificial Sequence
  Description of Artificial Sequence: Synthetic peptide
  XENP024693 scFv linker
GKPGSGKPGSGKPGSGKPGS

SEQ ID NO: 29697 - protein, 107 aa, Artificial Sequence
  Description of Artificial Sequence: Synthetic polypeptide
  VL of XENP024693
DIQMTQSPSSVSASVGDRVTITCRASQSISRLLAWYQQKPGKAPKLLIYAASSLQSGVPSRFSGSGSGTDFTLTISSLQPEDFATYYCQQAQSFPWTFGQGTKVEIK

SEQ ID NO: 29698 - protein, 11 aa, Artificial Sequence
  Description of Artificial Sequence: Synthetic peptide
  XENP024693 vlCDR1
RASQSISRLLA

SEQ ID NO: 29699 - protein, 7 aa, Artificial Sequence
  Description of Artificial Sequence: Synthetic peptide
  XENP024693 vlCDR2
AASSLQS

SEQ ID NO: 29700 - protein, 9 aa, Artificial Sequence
  Description of Artificial Sequence: Synthetic peptide
  XENP024693 vlCDR3
QQAQSFPWT

SEQ ID NO: 29701 - protein, 254 aa, Artificial Sequence
  Description of Artificial Sequence: Synthetic polypeptide
  XENP024693 scFv
DIQMTQSPSSVSASVGDRVTITCRASQSISRLLAWYQQKPGKAPKLLIYAASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGS

SEQ ID NO: 29702 - protein, 125 aa, Artificial Sequence; identical to SEQ ID NO: 29602
  Description of Artificial Sequence: Synthetic polypeptide
  VH of XENP024694

SEQ ID NO: 29703 - protein, 5 aa, Artificial Sequence
  Description of Artificial Sequence: Synthetic peptide
  XENP024694 vhCDR1
GYYMH

SEQ ID NO: 29704 - protein, 17 aa, Artificial Sequence
  Description of Artificial Sequence: Synthetic peptide
  XENP024694 vhCDR2
WINPHSGETNYAQKFQG

SEQ ID NO: 29705 - protein, 16 aa, Artificial Sequence
  Description of Artificial Sequence: Synthetic peptide
  XENP024694 vhCDR3
TYYYDTSGYYHDAFDV

SEQ ID NO: 29706 - protein, 20 aa, Artificial Sequence
  Description of Artificial Sequence: Synthetic peptide
  XENP024694 scFv linker
GKPGSGKPGSGKPGSGKPGS

SEQ ID NO: 29707 - protein, 107 aa, Artificial Sequence
  Description of Artificial Sequence: Synthetic polypeptide
  VL of XENP024694
DIQMTQSPSSVSASVGDRVTITCRASQDISRLLAWYQQKPGKAPKLLIYSASSLQSGVPSRFSGSGSGTDFTLTISSLQPEDFATYYCQQAQSFPWTFGQGTKVEIK

SEQ ID NO: 29708 - protein, 11 aa, Artificial Sequence
  Description of Artificial Sequence: Synthetic peptide
  XENP024694 vlCDR1
RASQDISRLLA

SEQ ID NO: 29709 - protein, 7 aa, Artificial Sequence
  Description of Artificial Sequence: Synthetic peptide
  XENP024694 vlCDR2
SASSLQS

SEQ ID NO: 29710 - protein, 9 aa, Artificial Sequence
  Description of Artificial Sequence: Synthetic peptide
  XENP024694 vlCDR3
QQAQSFPWT

SEQ ID NO: 29711 - protein, 254 aa, Artificial Sequence
  Description of Artificial Sequence: Synthetic polypeptide
  XENP024694 scFv
DIQMTQSPSSVSASVGDRVTITCRASQDISRLLAWYQQKPGKAPKLLIYSASSLQSGVPSRFSGSGSGTDFTLTISSLQPEDFATYYCQQAQSFPWTFGQGTKVEIKGKPGSGKPGSGKPGSGKPGSQVQLVQSGAEVKKPGASVKVSCKASGYTFTGYYMHWVRQAPGQGLEWMGWINPHSGETNYAQKFQGRVTMTRDTSISTAYMELSSLRSEDTAVYYCARTYYYDTSGYYHDAFDVWGQGTMVTVSSGS

SEQ ID NO: 29712 - protein, 454 aa, Artificial Sequence; identical to SEQ ID NO: 26362
  Description of Artificial Sequence: Synthetic polypeptide
  XENP022730 [ICOS]_H0L0_Fab-1G6_L1.194_H1.279 Fab-Fc Heavy Chain

SEQ ID NO: 29713 - protein, 480 aa, Artificial Sequence; identical to SEQ ID NO: 2930
  Description of Artificial Sequence: Synthetic polypeptide
  XENP022730 [ICOS]_H0L0_Fab-1G6_L1.194_H1.279 scFv-Fc Heavy Chain

SEQ ID NO: 29714 - protein, 214 aa, Artificial Sequence; identical to SEQ ID NO: 26297
  Description of Artificial Sequence: Synthetic polypeptide
  XENP022730 [ICOS]_H0L0_Fab-1G6_L1.194_H1.279 Light Chain

SEQ ID NO: 29715 - protein, 447 aa, Artificial Sequence; identical to SEQ ID NO: 26382
  Description of Artificial Sequence: Synthetic polypeptide
  XENP023377 11D4[OX40]_H0L0_Fab-1G6_L1.194_H1.279_scFv Fab-Fc Heavy Chain

SEQ ID NO: 29716 - protein, 480 aa, Artificial Sequence; identical to SEQ ID NO: 2870
  Description of Artificial Sequence: Synthetic polypeptide
  XENP023377 11D4[OX40]_H0L0_Fab-1G6_L1.194_H1.279_scFv scFv-Fc Heavy Chain

SEQ ID NO: 29717 - protein, 214 aa, Artificial Sequence; identical to SEQ ID NO: 26277
  Description of Artificial Sequence: Synthetic polypeptide
  XENP023377 11D4[OX40]_H0L0_Fab-1G6_L1.194_H1.279_scFv Light Chain

SEQ ID NO: 29718 - protein, 451 aa, Artificial Sequence; identical to SEQ ID NO: 26402
  Description of Artificial Sequence: Synthetic polypeptide
  XENP023378 1D8[GITR]_H0L0_Fab-1G6_L1.194_H1.279_scFv Fab-Fc Heavy Chain

SEQ ID NO: 29719 - protein, 480 aa, Artificial Sequence; identical to SEQ ID NO: 2870
  Description of Artificial Sequence: Synthetic polypeptide
  XENP023378 1D8[GITR]_H0L0_Fab-1G6_L1.194_H1.279_scFv scFv-Fc Heavy Chain

SEQ ID NO: 29720 - protein, 219 aa, Artificial Sequence; identical to SEQ ID NO: 26287
  Description of Artificial Sequence: Synthetic polypeptide
  XENP023378 1D8[GITR]_H0L0_Fab-1G6_L1.194_H1.279_scFv Light Chain

SEQ ID NO: 29721 - protein, 450 aa, Artificial Sequence; identical to SEQ ID NO: 26422
  Description of Artificial Sequence: Synthetic polypeptide
  XENP023379 20H4.9[4-1BB]_H0L0_Fab-1G6_L1.194_H1.279_scFv Fab-Fc Heavy Chain

SEQ ID NO: 29722 - protein, 480 aa, Artificial Sequence; identical to SEQ ID NO: 2870
  Description of Artificial Sequence: Synthetic polypeptide
  XENP023379 20H4.9[4-1BB]_H0L0_Fab-1G6_L1.194_H1.279_scFv scFv-Fc Heavy Chain

SEQ ID NO: 29723 - protein, 216 aa, Artificial Sequence; identical to SEQ ID NO: 26267
  Description of Artificial Sequence: Synthetic polypeptide
  XENP023379 20H4.9[4-1BB]_H0L0_Fab-1G6_L1.194_H1.279_scFv Light Chain

SEQ ID NO: 29724 - protein, 454 aa, Artificial Sequence; identical to SEQ ID NO: 26442
  Description of Artificial Sequence: Synthetic polypeptide
  XENP020896 [ICOS]_H0L0_Fab-1G6_L1.194_H1.279 Fab-Fc Heavy Chain

SEQ ID NO: 29725 - protein, 480 aa, Artificial Sequence; identical to SEQ ID NO: 2870
  Description of Artificial Sequence: Synthetic polypeptide
  XENP020896 [ICOS]_H0L0_Fab-1G6_L1.194_H1.279 scFv-Fc Heavy Chain

SEQ ID NO: 29726 - protein, 214 aa, Artificial Sequence; identical to SEQ ID NO: 26297
  Description of Artificial Sequence: Synthetic polypeptide
  XENP020896 [ICOS]_H0L0_Fab-1G6_L1.194_H1.279 Light Chain

SEQ ID NO: 29727 - protein, 454 aa, Artificial Sequence; identical to SEQ ID NO: 26442
  Description of Artificial Sequence: Synthetic polypeptide
  XENP022433 [ICOS]_H0_L0.7_Fab-1G6_L1.194_H1.279 Fab-Fc Heavy Chain

SEQ ID NO: 29728 - protein, 480 aa, Artificial Sequence; identical to SEQ ID NO: 2870
  Description of Artificial Sequence: Synthetic polypeptide
  XENP022433 [ICOS]_H0_L0.7_Fab-1G6_L1.194_H1.279 scFv-Fc Heavy Chain

SEQ ID NO: 29729 - protein, 214 aa, Artificial Sequence; identical to SEQ ID NO: 26477
  Description of Artificial Sequence: Synthetic polypeptide
  XENP022433 [ICOS]_H0_L0.7_Fab-1G6_L1.194_H1.279 Light Chain

SEQ ID NO: 29730 - protein, 454 aa, Artificial Sequence; identical to SEQ ID NO: 26442
  Description of Artificial Sequence: Synthetic polypeptide
  XENP022744 [ICOS]_H0_L0.34_Fab-1G6_L1.194_H1.279 Fab-Fc Heavy Chain

SEQ ID NO: 29731 - protein, 480 aa, Artificial Sequence; identical to SEQ ID NO: 2870
  Description of Artificial Sequence: Synthetic polypeptide
  XENP022744 [ICOS]_H0_L0.34_Fab-1G6_L1.194_H1.279 scFv-Fc Heavy Chain

SEQ ID NO: 29732 - protein, 214 aa, Artificial Sequence; identical to SEQ ID NO: 26497
  Description of Artificial Sequence: Synthetic polypeptide
  XENP022744 [ICOS]_H0_L0.34_Fab-1G6_L1.194_H1.279 Light Chain

SEQ ID NO: 29733 - protein, 454 aa, Artificial Sequence; identical to SEQ ID NO: 26442
  Description of Artificial Sequence: Synthetic polypeptide
  XENP022746 [ICOS]_H0_L0.36_Fab-1G6_L1.194_H1.279 Fab-Fc Heavy Chain

SEQ ID NO: 29734 - protein, 480 aa, Artificial Sequence; identical to SEQ ID NO: 2870
  Description of Artificial Sequence: Synthetic polypeptide
  XENP022746 [ICOS]_H0_L0.36_Fab-1G6_L1.194_H1.279 scFv-Fc Heavy Chain

SEQ ID NO: 29735 - protein, 214 aa, Artificial Sequence; identical to SEQ ID NO: 26517
  Description of Artificial Sequence: Synthetic polypeptide
  XENP022746 [ICOS]_H0_L0.36_Fab-1G6_L1.194_H1.279 Light Chain

SEQ ID NO: 29736 - protein, 454 aa, Artificial Sequence; identical to SEQ ID NO: 26442
  Description of Artificial Sequence: Synthetic polypeptide
  XENP022747 [ICOS]_H0_L0.37_Fab-1G6_L1.194_H1.279 Fab-Fc Heavy Chain

SEQ ID NO: 29737 - protein, 480 aa, Artificial Sequence; identical to SEQ ID NO: 2870
  Description of Artificial Sequence: Synthetic polypeptide
  XENP022747 [ICOS]_H0_L0.37_Fab-1G6_L1.194_H1.279 scFv-Fc Heavy Chain

SEQ ID NO: 29738 - protein, 214 aa, Artificial Sequence; identical to SEQ ID NO: 26537
  Description of Artificial Sequence: Synthetic polypeptide
  XENP022747 [ICOS]_H0_L0.37_Fab-1G6_L1.194_H1.279 Light Chain

SEQ ID NO: 29739 - protein, 454 aa, Artificial Sequence; identical to SEQ ID NO: 26442
  Description of Artificial Sequence: Synthetic polypeptide
  XENP022748 [ICOS]_H0_L0.38_Fab-1G6_L1.194_H1.279 Fab-Fc Heavy Chain

SEQ ID NO: 29740 - protein, 480 aa, Artificial Sequence; identical to SEQ ID NO: 2870
  Description of Artificial Sequence: Synthetic polypeptide
  XENP022748 [ICOS]_H0_L0.38_Fab-1G6_L1.194_H1.279 scFv-Fc Heavy Chain

SEQ ID NO: 29741 - protein, 214 aa, Artificial Sequence; identical to SEQ ID NO: 26557
  Description of Artificial Sequence: Synthetic polypeptide
  XENP022748 [ICOS]_H0_L0.38_Fab-1G6_L1.194_H1.279 Light Chain

SEQ ID NO: 29742 - protein, 454 aa, Artificial Sequence; identical to SEQ ID NO: 26562
  Description of Artificial Sequence: Synthetic polypeptide
  XENP023092 [ICOS]_H0.66_L0_Fab-1G6_L1.194_H1.279 Fab-Fc Heavy Chain

SEQ ID NO: 29743 - protein, 480 aa, Artificial Sequence; identical to SEQ ID NO: 2870
  Description of Artificial Sequence: Synthetic polypeptide
  XENP023092 [ICOS]_H0.66_L0_Fab-1G6_L1.194_H1.279 scFv-Fc Heavy Chain

SEQ ID NO: 29744 - protein, 214 aa, Artificial Sequence; identical to SEQ ID NO: 26297
  Description of Artificial Sequence: Synthetic polypeptide
  XENP023092 [ICOS]_H0.66_L0_Fab-1G6_L1.194_H1.279 Light Chain

SEQ ID NO: 29745 - protein, 454 aa, Artificial Sequence; identical to SEQ ID NO: 26562
  Description of Artificial Sequence: Synthetic polypeptide
  XENP023410 [ICOS]_H0.66_L0.34_Fab-1G6_L1.194_H1.279 Fab-Fc Heavy Chain

SEQ ID NO: 29746 - protein, 480 aa, Artificial Sequence; identical to SEQ ID NO: 2870
  Description of Artificial Sequence: Synthetic polypeptide
  XENP023410 [ICOS]_H0.66_L0.34_Fab-1G6_L1.194_H1.279 scFv-Fc Heavy Chain

SEQ ID NO: 29747 - protein, 214 aa, Artificial Sequence; identical to SEQ ID NO: 26497
  Description of Artificial Sequence: Synthetic polypeptide
  XENP023410 [ICOS]_H0.66_L0.34_Fab-1G6_L1.194_H1.279 Light Chain

SEQ ID NO: 29748 - protein, 454 aa, Artificial Sequence; identical to SEQ ID NO: 26362
  Description of Artificial Sequence: Synthetic polypeptide
  XENP022730 [ICOS]_H0L0_Fab-1G6_L1.194_H1.279 Fab-Fc Heavy Chain

SEQ ID NO: 29749 - protein, 480 aa, Artificial Sequence; identical to SEQ ID NO: 2930
  Description of Artificial Sequence: Synthetic polypeptide
  XENP022730 [ICOS]_H0L0_Fab-1G6_L1.194_H1.279 scFv-Fc Heavy Chain

SEQ ID NO: 29750 - protein, 214 aa, Artificial Sequence; identical to SEQ ID NO: 26297
  Description of Artificial Sequence: Synthetic polypeptide
  XENP022730 [ICOS]_H0L0_Fab-1G6_L1.194_H1.279 Light Chain

SEQ ID NO: 29751 - protein, 454 aa, Artificial Sequence; identical to SEQ ID NO: 26362
  Description of Artificial Sequence: Synthetic polypeptide
  XENP022974 [ICOS]_H0_L0.34_Fab-1G6_L1.194_H1.279 Fab-Fc Heavy Chain

SEQ ID NO: 29752 - protein, 480 aa, Artificial Sequence; identical to SEQ ID NO: 2930
  Description of Artificial Sequence: Synthetic polypeptide
  XENP022974 [ICOS]_H0_L0.34_Fab-1G6_L1.194_H1.279 scFv-Fc Heavy Chain

SEQ ID NO: 29753 - protein, 214 aa, Artificial Sequence; identical to SEQ ID NO: 26497
  Description of Artificial Sequence: Synthetic polypeptide
  XENP022974 [ICOS]_H0_L0.34_Fab-1G6_L1.194_H1.279 Light Chain

SEQ ID NO: 29754 - protein, 454 aa, Artificial Sequence; identical to SEQ ID NO: 26642
  Description of Artificial Sequence: Synthetic polypeptide
  XENP023104 [ICOS]_H0.66_L0_Fab-1G6_L1.194_H1.279 Fab-Fc Heavy Chain

SEQ ID NO: 29755 - protein, 480 aa, Artificial Sequence; identical to SEQ ID NO: 2930
  Description of Artificial Sequence: Synthetic polypeptide
  XENP023104 [ICOS]_H0.66_L0_Fab-1G6_L1.194_H1.279 scFv-Fc Heavy Chain

SEQ ID NO: 29756 - protein, 214 aa, Artificial Sequence; identical to SEQ ID NO: 26297
  Description of Artificial Sequence: Synthetic polypeptide
  XENP023104 [ICOS]_H0.66_L0_Fab-1G6_L1.194_H1.279 Light Chain

SEQ ID NO: 29757 - protein, 454 aa, Artificial Sequence; identical to SEQ ID NO: 26642
  Description of Artificial Sequence: Synthetic polypeptide
  XENP023411 [ICOS]_H0.66_L0.34_Fab-1G6_L1.194_H1.279 Fab-Fc Heavy Chain

SEQ ID NO: 29758 - protein, 480 aa, Artificial Sequence; identical to SEQ ID NO: 2930
  Description of Artificial Sequence: Synthetic polypeptide
  XENP023411 [ICOS]_H0.66_L0.34_Fab-1G6_L1.194_H1.279 scFv-Fc Heavy Chain

SEQ ID NO: 29759 - protein, 214 aa, Artificial Sequence; identical to SEQ ID NO: 26497
  Description of Artificial Sequence: Synthetic polypeptide
  XENP023411 [ICOS]_H0.66_L0.34_Fab-1G6_L1.194_H1.279 Light Chain

SEQ ID NO: 29760 - protein, 452 aa, Artificial Sequence; identical to SEQ ID NO: 26682
  Description of Artificial Sequence: Synthetic polypeptide
  XENP021828 GSK_314.8[ICOS]_H0L0_Fab-1G6_L1.194_H1.279_scFv Fab-Fc Heavy Chain

SEQ ID NO: 29761 - protein, 480 aa, Artificial Sequence; identical to SEQ ID NO: 2870
  Description of Artificial Sequence: Synthetic polypeptide
  XENP021828 GSK_314.8[ICOS]_H0L0_Fab-1G6_L1.194_H1.279_scFv scFv -Fc Heavy Chain

SEQ ID NO: 29762 - protein, 219 aa, Artificial Sequence; identical to SEQ ID NO: 26307
  Description of Artificial Sequence: Synthetic polypeptide
  XENP021828 GSK_314.8[ICOS]_H0L0_Fab-1G6_L1.194_H1.279_scFv Light Chain

SEQ ID NO: 29763 - protein, 453 aa, Artificial Sequence; identical to SEQ ID NO: 26702
  Description of Artificial Sequence: Synthetic polypeptide
  XENP021829 GSK_88.2[ICOS]_H0L0_Fab-1G6_L1.194_H1.279_scFv Fab-Fc Heavy Chain

SEQ ID NO: 29764 - protein, 480 aa, Artificial Sequence; identical to SEQ ID NO: 2870
  Description of Artificial Sequence: Synthetic polypeptide
  XENP021829 GSK_88.2[ICOS]_H0L0_Fab-1G6_L1.194_H1.279_scFv scFv-Fc Heavy Chain

SEQ ID NO: 29765 - protein, 219 aa, Artificial Sequence; identical to SEQ ID NO: 26317
  Description of Artificial Sequence: Synthetic polypeptide
  XENP021829 GSK_88.2[ICOS]_H0L0_Fab-1G6_L1.194_H1.279_scFv Light Chain

SEQ ID NO: 29766 - protein, 454 aa, Artificial Sequence; identical to SEQ ID NO: 26722
  Description of Artificial Sequence: Synthetic polypeptide
  XENP021830 jMab-138[ICOS]_H0L0_Fab-1G6_L1.194_H1.279_scFv Fab-Fc Heavy Chain

SEQ ID NO: 29767 - protein, 480 aa, Artificial Sequence; identical to SEQ ID NO: 2870
  Description of Artificial Sequence: Synthetic polypeptide
  XENP021830 jMab-138[ICOS]_H0L0_Fab-1G6_L1.194_H1.279_scFv scFv-Fc Heavy Chain

SEQ ID NO: 29768 - protein, 216 aa, Artificial Sequence; identical to SEQ ID NO: 26327
  Description of Artificial Sequence: Synthetic polypeptide
  XENP021830 jMab-138[ICOS]_H0L0_Fab-1G6_L1.194_H1.279_scFv Light Chain

SEQ ID NO: 29769 - protein, 454 aa, Artificial Sequence; identical to SEQ ID NO: 26742
  Description of Artificial Sequence: Synthetic polypeptide
  XENP021831 jMab-139[ICOS]_H0L0_Fab-1G6_L1.194_H1.279_scFv Fab-Fc Heavy Chain

SEQ ID NO: 29770 - protein, 480 aa, Artificial Sequence; identical to SEQ ID NO: 2870
  Description of Artificial Sequence: Synthetic polypeptide
  XENP021831 jMab-139[ICOS]_H0L0_Fab-1G6_L1.194_H1.279_scFv scFv-Fc Heavy Chain

SEQ ID NO: 29771 - protein, 216 aa, Artificial Sequence; identical to SEQ ID NO: 26337
  Description of Artificial Sequence: Synthetic polypeptide
  XENP021831 jMab-139[ICOS]_H0L0_Fab-1G6_L1.194_H1.279_scFv Light Chain

SEQ ID NO: 29772 - protein, 450 aa, Artificial Sequence; identical to SEQ ID NO: 26762
  Description of Artificial Sequence: Synthetic polypeptide
  XENP022348 WO2016059602_GSK_H0L0_Fab-1G6_L1.194_H1.279_scFv Fab -Fc Heavy Chain

SEQ ID NO: 29773 - protein, 480 aa, Artificial Sequence; identical to SEQ ID NO: 2870
  Description of Artificial Sequence: Synthetic polypeptide
  XENP022348 WO2016059602_GSK_H0L0_Fab-1G6_L1.194_H1.279_scFv scFv -Fc Heavy Chain

SEQ ID NO: 29774 - protein, 213 aa, Artificial Sequence; identical to SEQ ID NO: 26347
  Description of Artificial Sequence: Synthetic polypeptide
  XENP022348 WO2016059602_GSK_H0L0_Fab-1G6_L1.194_H1.279_scFv Light Chain

SEQ ID NO: 29775 - protein, 446 aa, Artificial Sequence; identical to SEQ ID NO: 26782
  Description of Artificial Sequence: Synthetic polypeptide
  XENP023059 Jounce_37A10S713[ICOS]_H0L0_Fab-1G6_[PD-1]_L1.194_H1 .279_scFv Fab-Fc Heavy Chain

SEQ ID NO: 29776 - protein, 480 aa, Artificial Sequence; identical to SEQ ID NO: 2870
  Description of Artificial Sequence: Synthetic polypeptide
  XENP023059 Jounce_37A10S713[ICOS]_H0L0_Fab-1G6_[PD-1]_L1.194_H1 .279_scFv scFv-Fc Heavy Chain

SEQ ID NO: 29777 - protein, 218 aa, Artificial Sequence; identical to SEQ ID NO: 26357
  Description of Artificial Sequence: Synthetic polypeptide
  XENP023059 Jounce_37A10S713[ICOS]_H0L0_Fab-1G6_[PD-1]_L1.194_H1 .279_scFv Light Chain

SEQ ID NO: 29778 - protein, 329 aa, Artificial Sequence; identical to SEQ ID NO: 28669
  Description of Artificial Sequence: Synthetic polypeptide
  Fab-Fc Heavy Chain

SEQ ID NO: 29779 - protein, 113 aa, Artificial Sequence; identical to SEQ ID NO: 26849
  Description of Artificial Sequence: Synthetic polypeptide
  Fab-scFv-Fc Heavy Chain

SEQ ID NO: 29780 - protein, 235 aa, Artificial Sequence
  Description of Artificial Sequence: Synthetic polypeptide
  Fab-scFv-Fc Heavy Chain
GGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29781 - protein, 107 aa, Artificial Sequence [sequence omitted]

SEQ ID NO: 29782 - protein, 113 aa, Artificial Sequence; identical to SEQ ID NO: 26907
  Description of Artificial Sequence: Synthetic polypeptide
  Heavy Chain

SEQ ID NO: 29783 - protein, 235 aa, Artificial Sequence
  Description of Artificial Sequence: Synthetic polypeptide
  Heavy Chain
GGGGSGGGGSKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29784 - protein, 107 aa, Artificial Sequence [sequence omitted]

SEQ ID NO: 29785 - protein, 329 aa, Artificial Sequence; identical to SEQ ID NO: 28669
  Description of Artificial Sequence: Synthetic polypeptide
  Heavy Chain 1

SEQ ID NO: 29786 - protein, 329 aa, Artificial Sequence
  Description of Artificial Sequence: Synthetic polypeptide
  Heavy Chain 2
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29787 - protein, 107 aa, Artificial Sequence [sequence omitted]

SEQ ID NO: 29788 - protein, 107 aa, Artificial Sequence [sequence omitted]

SEQ ID NO: 29789 - protein, 342 aa, Artificial Sequence
  Description of Artificial Sequence: Synthetic polypeptide
  Heavy Chain
ASTKGPSVFPLAPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29790 - protein, 120 aa, Artificial Sequence
  Description of Artificial Sequence: Synthetic polypeptide
  Light Chain
RTVAAPSVFIFPPRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 29791 - protein, 273 aa, Artificial Sequence
  Description of Artificial Sequence: Synthetic polypeptide
  Heavy Chain 1
GGGSGGGGGGCGGGEVAACEKEVAALEKEVAALEKEVAALEKEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 29792 - protein, 329 aa, Artificial Sequence; identical to SEQ ID NO: 29786
  Description of Artificial Sequence: Synthetic polypeptide
  Heavy Chain 2

SEQ ID NO: 29793 - protein, 42 aa, Artificial Sequence
  Description of Artificial Sequence: Synthetic polypeptide
  Light Chain 1
GGGSGGGGGGCGGGKVAACKEKVAALKEKVAALKEKVAALKE

SEQ ID NO: 29794 - protein, 107 aa, Artificial Sequence [sequence omitted]

SEQ ID NO: 29795 - protein, 442 aa, Artificial Sequence; identical to SEQ ID NO: 26802
  Description of Artificial Sequence: Synthetic polypeptide
  XENP018920 nivolumab[PD-1]_H0L0_Fab-[anti-ICOS]_H0L0_scFv Fab-Fc Heavy Chain

SEQ ID NO: 29796 - protein, 471 aa, Artificial Sequence; identical to SEQ ID NO: 26807
  Description of Artificial Sequence: Synthetic polypeptide
  XENP018920 nivolumab[PD-1]_H0L0_Fab-[anti-ICOS]_H0L0_scFv scFv -Fc Heavy Chain

SEQ ID NO: 29797 - protein, 214 aa, Artificial Sequence; identical to SEQ ID NO: 16146
  Description of Artificial Sequence: Synthetic polypeptide
  XENP018920 nivolumab[PD-1]_H0L0_Fab-[anti-ICOS]_H0L0_scFv Light Chain

SEQ ID NO: 29798 - protein, 456 aa, Artificial Sequence; identical to SEQ ID NO: 26822
  Description of Artificial Sequence: Synthetic polypeptide
  XENP024130 LOPD180[PD-1]_H1L1_Fab-[anti-ICOS]_H0L0_scFv Fab-Fc Heavy Chain

SEQ ID NO: 29799 - protein, 483 aa, Artificial Sequence; identical to SEQ ID NO: 26827
  Description of Artificial Sequence: Synthetic polypeptide
  XENP024130 LOPD180[PD-1]_H1L1_Fab-[anti-ICOS]_H0L0_scFv scFv-Fc Heavy Chain

SEQ ID NO: 29800 - protein, 216 aa, Artificial Sequence; identical to SEQ ID NO: 26837
  Description of Artificial Sequence: Synthetic polypeptide
  XENP024130 LOPD180[PD-1]_H1L1_Fab-[anti-ICOS]_H0L0_scFv Light Chain

SEQ ID NO: 29801 - protein, 454 aa, Artificial Sequence; identical to SEQ ID NO: 26442
  Description of Artificial Sequence: Synthetic polypeptide
  XENP023406 [anti-ICOS]_H0L0_Fab-[anti-ICOS]_H0L0_Fab_1G6_L1.194 _H1.279_scFv Fab-Fc Heavy Chain

SEQ ID NO: 29802 - protein, 722 aa, Artificial Sequence; identical to SEQ ID NO: 26847
  Description of Artificial Sequence: Synthetic polypeptide
  XENP023406 [anti-ICOS]_H0L0_Fab-[anti-ICOS]_H0L0_Fab_1G6_L1.194 _H1.279_scFv Fab-scFv-Fc Heavy Chain

SEQ ID NO: 29803 - protein, 214 aa, Artificial Sequence; identical to SEQ ID NO: 26297
  Description of Artificial Sequence: Synthetic polypeptide
  XENP023406 [anti-ICOS]_H0L0_Fab-[anti-ICOS]_H0L0_Fab_1G6_L1.194 _H1.279_scFv Light Chain

SEQ ID NO: 29804 - protein, 455 aa, Artificial Sequence; identical to SEQ ID NO: 26863
  Description of Artificial Sequence: Synthetic polypeptide
  XENP023407 [anti-ICOS]_H0L0_Fab-[anti-ICOS]_H0L0_Fab_1G6_L1.194 _H1.279_scFv Fab-Fc Heavy Chain

SEQ ID NO: 29805 - protein, 723 aa, Artificial Sequence; identical to SEQ ID NO: 26868
  Description of Artificial Sequence: Synthetic polypeptide
  XENP023407 [anti-ICOS]_H0L0_Fab-[anti-ICOS]_H0L0_Fab_1G6_L1.194 _H1.279_scFv Fab-scFv-Fc Heavy Chain

SEQ ID NO: 29806 - protein, 214 aa, Artificial Sequence; identical to SEQ ID NO: 26297
  Description of Artificial Sequence: Synthetic polypeptide
  XENP023407 [anti-ICOS]_H0L0_Fab-[anti-ICOS]_H0L0_Fab_1G6_L1.194 _H1.279_scFv Light Chain

SEQ ID NO: 29807 - protein, 451 aa, Artificial Sequence; identical to SEQ ID NO: 26884
  Description of Artificial Sequence: Synthetic polypeptide
  XENP024128 1G6_L1.194_H1.279_Fab-1G6_L1.194_H1.279_Fab_[anti-ICOS] _H0L0_scFv Fab-Fc Heavy Chain

SEQ ID NO: 29808 - protein, 722 aa, Artificial Sequence; identical to SEQ ID NO: 26889
  Description of Artificial Sequence: Synthetic polypeptide
  XENP024128 1G6_L1.194_H1.279_Fab-1G6_L1.194_H1.279_Fab_[anti-ICOS] _H0L0_scFv Fab-scFv-Fc Heavy Chain

SEQ ID NO: 29809 - protein, 214 aa, Artificial Sequence; identical to SEQ ID NO: 21486
  Description of Artificial Sequence: Synthetic polypeptide
  XENP024128 1G6_L1.194_H1.279_Fab-1G6_L1.194_H1.279_Fab_[anti-ICOS] _H0L0_scFv Light Chain

SEQ ID NO: 29810 - protein, 722 aa, Artificial Sequence; identical to SEQ ID NO: 26905
  Description of Artificial Sequence: Synthetic polypeptide
  XENP024123 1G6_H1.279_L1.194_Fab_(G4S)2_[anti-ICOS]_H0L0_scFv20_Fc _IgG1 Heavy Chain

SEQ ID NO: 29811 - protein, 214 aa, Artificial Sequence; identical to SEQ ID NO: 21486
  Description of Artificial Sequence: Synthetic polypeptide
  XENP024123 1G6_H1.279_L1.194_Fab_(G4S)2_[anti-ICOS]_H0L0_scFv20_Fc _IgG1 Light Chain

SEQ ID NO: 29812 - protein, 727 aa, Artificial Sequence; identical to SEQ ID NO: 26921
  Description of Artificial Sequence: Synthetic polypeptide
  XENP024125 LOPD180[PD-1]_H1L1_Fab_(G4S)2_[anti-ICOS]_H0L0_scFv20 _Fc_IgG1 Heavy Chain

SEQ ID NO: 29813 - protein, 216 aa, Artificial Sequence; identical to SEQ ID NO: 26837
  Description of Artificial Sequence: Synthetic polypeptide
  XENP024125 LOPD180[PD-1]_H1L1_Fab_(G4S)2_[anti-ICOS]_H0L0_scFv20 _Fc_IgG1 Light Chain

SEQ ID NO: 29814 - protein, 451 aa, Artificial Sequence; identical to SEQ ID NO: 26884
  Description of Artificial Sequence: Synthetic polypeptide
  XENP024134 1G6_H1.279_L1.194_Fab-[anti-ICOS]_H0L0_Fab-IgG1 Heavy Chain 1

SEQ ID NO: 29815 - protein, 454 aa, Artificial Sequence; identical to SEQ ID NO: 26942
  Description of Artificial Sequence: Synthetic polypeptide
  XENP024134 1G6_H1.279_L1.194_Fab-[anti-ICOS]_H0L0_Fab-IgG1 Heavy Chain 2

SEQ ID NO: 29816 - protein, 214 aa, Artificial Sequence; identical to SEQ ID NO: 21486
  Description of Artificial Sequence: Synthetic polypeptide
  XENP024134 1G6_H1.279_L1.194_Fab-[anti-ICOS]_H0L0_Fab-IgG1 Light Chain 1

SEQ ID NO: 29817 - protein, 214 aa, Artificial Sequence; identical to SEQ ID NO: 26297
  Description of Artificial Sequence: Synthetic polypeptide
  XENP024134 1G6_H1.279_L1.194_Fab-[anti-ICOS]_H0L0_Fab-IgG1 Light Chain 2

SEQ ID NO: 29818 - protein, 589 aa, Artificial Sequence; identical to SEQ ID NO: 26957
  Description of Artificial Sequence: Synthetic polypeptide
  XENP024122 1G6_H1.279_L1.194_[anti-ICOS]_H0L0_IgG1 Heavy Chain

SEQ ID NO: 29819 - protein, 334 aa, Artificial Sequence; identical to SEQ ID NO: 26967
  Description of Artificial Sequence: Synthetic polypeptide
  XENP024122 1G6_H1.279_L1.194_[anti-ICOS]_H0L0_IgG1 Light Chain

SEQ ID NO: 29820 - protein, 502 aa, Artificial Sequence; identical to SEQ ID NO: 26977
  Description of Artificial Sequence: Synthetic polypeptide
  XENP024132 1G6_L1.194_1G6_H1.279_DART-[anti-ICOS]_H0L0_Fab-Fc_IgG1 Heavy Chain 1

SEQ ID NO: 29821 - protein, 454 aa, Artificial Sequence; identical to SEQ ID NO: 26942
  Description of Artificial Sequence: Synthetic polypeptide
  XENP024132 1G6_L1.194_1G6_H1.279_DART-[anti-ICOS]_H0L0_Fab-Fc_IgG1 Heavy Chain 2

SEQ ID NO: 29822 - protein, 281 aa, Artificial Sequence; identical to SEQ ID NO: 26992
  Description of Artificial Sequence: Synthetic polypeptide
  XENP024132 1G6_L1.194_1G6_H1.279_DART-[anti-ICOS]_H0L0_Fab-Fc_IgG1 Light Chain 1

SEQ ID NO: 29823 - protein, 214 aa, Artificial Sequence; identical to SEQ ID NO: 26297
  Description of Artificial Sequence: Synthetic polypeptide
  XENP024132 1G6_L1.194_1G6_H1.279_DART-[anti-ICOS]_H0L0_Fab-Fc_IgG1 Light Chain 2

SEQ ID NO: 29824 - protein, 503 aa, Artificial Sequence; identical to SEQ ID NO: 27007
  Description of Artificial Sequence: Synthetic polypeptide
  XENP024133 mAb7(1.2)[PD-1]_L1_mAb7(1.2)[PD-1]_H1_DART-[anti-ICOS] _H0L0_Fab-Fc_IgG1 Heavy Chain 1

SEQ ID NO: 29825 - protein, 454 aa, Artificial Sequence; identical to SEQ ID NO: 26942
  Description of Artificial Sequence: Synthetic polypeptide
  XENP024133 mAb7(1.2)[PD-1]_L1_mAb7(1.2)[PD-1]_H1_DART-[anti-ICOS] _H0L0_Fab-Fc_IgG1 Heavy Chain 2

SEQ ID NO: 29826 - protein, 282 aa, Artificial Sequence; identical to SEQ ID NO: 27022
  Description of Artificial Sequence: Synthetic polypeptide
  XENP024133 mAb7(1.2)[PD-1]_L1_mAb7(1.2)[PD-1]_H1_DART-[anti-ICOS] _H0L0_Fab-Fc_IgG1 Light Chain 1

SEQ ID NO: 29827 - protein, 214 aa, Artificial Sequence; identical to SEQ ID NO: 26297
  Description of Artificial Sequence: Synthetic polypeptide
  XENP024133 mAb7(1.2)[PD-1]_L1_mAb7(1.2)[PD-1]_H1_DART-[anti-ICOS] _H0L0_Fab-Fc_IgG1 Light Chain 2

SEQ ID NO: 29828 - protein, 454 aa, Artificial Sequence; identical to SEQ ID NO: 26442
  Description of Artificial Sequence: Synthetic polypeptide
  XENP021749 [anti-ICOS]_H0L0_Fab-[anti-CTLA-4]_H3.23_L0.129_scFv Fab-Fc Heavy Chain

SEQ ID NO: 29829 - protein, 477 aa, Artificial Sequence; identical to SEQ ID NO: 2394
  Description of Artificial Sequence: Synthetic polypeptide
  XENP021749 [anti-ICOS]_H0L0_Fab-[anti-CTLA-4]_H3.23_L0.129_scFv scFv-Fc Heavy Chain

SEQ ID NO: 29830 - protein, 214 aa, Artificial Sequence; identical to SEQ ID NO: 26297
  Description of Artificial Sequence: Synthetic polypeptide
  XENP021749 [anti-ICOS]_H0L0_Fab-[anti-CTLA-4]_H3.23_L0.129_scFv Light Chain

SEQ ID NO: 29831 - protein, 450 aa, Artificial Sequence; identical to SEQ ID NO: 2785
  Description of Artificial Sequence: Synthetic polypeptide
  XENP024359 7G8_H3.30_L1.34_Fab-[anti-ICOS]_H0L0_Fab Heavy Chain 1

SEQ ID NO: 29832 - protein, 454 aa, Artificial Sequence; identical to SEQ ID NO: 26942
  Description of Artificial Sequence: Synthetic polypeptide
  XENP024359 7G8_H3.30_L1.34_Fab-[anti-ICOS]_H0L0_Fab Heavy Chain 2

SEQ ID NO: 29833 - protein, 218 aa, Artificial Sequence; identical to SEQ ID NO: 2420
  Description of Artificial Sequence: Synthetic polypeptide
  XENP024359 7G8_H3.30_L1.34_Fab-[anti-ICOS]_H0L0_Fab Light Chain 1

SEQ ID NO: 29834 - protein, 214 aa, Artificial Sequence; identical to SEQ ID NO: 26297
  Description of Artificial Sequence: Synthetic polypeptide
  XENP024359 7G8_H3.30_L1.34_Fab-[anti-ICOS]_H0L0_Fab Light Chain 2

SEQ ID NO: 29835 - protein, 447 aa, Artificial Sequence; identical to SEQ ID NO: 2865
  Description of Artificial Sequence: Synthetic polypeptide
  XENP024360 2A11_H1.144_L2.142_Fab-[anti-ICOS]_H0L0_Fab Heavy Chain 1

SEQ ID NO: 29836 - protein, 454 aa, Artificial Sequence; identical to SEQ ID NO: 26942
  Description of Artificial Sequence: Synthetic polypeptide
  XENP024360 2A11_H1.144_L2.142_Fab-[anti-ICOS]_H0L0_Fab Heavy Chain 2

SEQ ID NO: 29837 - protein, 214 aa, Artificial Sequence; identical to SEQ ID NO: 2660
  Description of Artificial Sequence: Synthetic polypeptide
  XENP024360 2A11_H1.144_L2.142_Fab-[anti-ICOS]_H0L0_Fab Light Chain 1

SEQ ID NO: 29838 - protein, 214 aa, Artificial Sequence; identical to SEQ ID NO: 26297
  Description of Artificial Sequence: Synthetic polypeptide
  XENP024360 2A11_H1.144_L2.142_Fab-[anti-ICOS]_H0L0_Fab Light Chain 2

SEQ ID NO: 29839 - protein, 446 aa, Artificial Sequence; identical to SEQ ID NO: 27097
  Description of Artificial Sequence: Synthetic polypeptide
  XENP024361 3H3_H1_L2.1_Fab-[anti-ICOS]_H0L0_Fab Heavy Chain 1

SEQ ID NO: 29840 - protein, 454 aa, Artificial Sequence; identical to SEQ ID NO: 26942
  Description of Artificial Sequence: Synthetic polypeptide
  XENP024361 3H3_H1_L2.1_Fab-[anti-ICOS]_H0L0_Fab Heavy Chain 2

SEQ ID NO: 29841 - protein, 219 aa, Artificial Sequence; identical to SEQ ID NO: 3510
  Description of Artificial Sequence: Synthetic polypeptide
  XENP024361 3H3_H1_L2.1_Fab-[anti-ICOS]_H0L0_Fab Light Chain 1

SEQ ID NO: 29842 - protein, 214 aa, Artificial Sequence; identical to SEQ ID NO: 26297
  Description of Artificial Sequence: Synthetic polypeptide
  XENP024361 3H3_H1_L2.1_Fab-[anti-ICOS]_H0L0_Fab Light Chain 2

SEQ ID NO: 29843 - protein, 447 aa, Artificial Sequence; identical to SEQ ID NO: 27117
  Description of Artificial Sequence: Synthetic polypeptide
  XENP021748 YW243.55.S70[PD-L1]_H0L0_Fab-[anti-ICOS]_H0L0_scFv Fab-Fc Heavy Chain

SEQ ID NO: 29844 - protein, 483 aa, Artificial Sequence; identical to SEQ ID NO: 26827
  Description of Artificial Sequence: Synthetic polypeptide
  XENP021748 YW243.55.S70[PD-L1]_H0L0_Fab-[anti-ICOS]_H0L0_scFv scFv-Fc Heavy Chain

SEQ ID NO: 29845 - protein, 214 aa, Artificial Sequence; identical to SEQ ID NO: 27132
  Description of Artificial Sequence: Synthetic polypeptide
  XENP021748 YW243.55.S70[PD-L1]_H0L0_Fab-[anti-ICOS]_H0L0_scFv Light Chain

SEQ ID NO: 29846 - protein, 450 aa, Artificial Sequence; identical to SEQ ID NO: 27137
  Description of Artificial Sequence: Synthetic polypeptide
  XENP024129 durvalumab[PD-L1]_H1L1_Fab-[anti-ICOS]_H0L0_scFv Fab -Fc Heavy Chain

SEQ ID NO: 29847 - protein, 483 aa, Artificial Sequence; identical to SEQ ID NO: 26827
  Description of Artificial Sequence: Synthetic polypeptide
  XENP024129 durvalumab[PD-L1]_H1L1_Fab-[anti-ICOS]_H0L0_scFv scFv -Fc Heavy Chain

SEQ ID NO: 29848 - protein, 215 aa, Artificial Sequence; identical to SEQ ID NO: 27152
  Description of Artificial Sequence: Synthetic polypeptide
  XENP024129 durvalumab[PD-L1]_H1L1_Fab-[anti-ICOS]_H0L0_scFv Light Chain

SEQ ID NO: 29849 - protein, 449 aa, Artificial Sequence; identical to SEQ ID NO: 27157
  Description of Artificial Sequence: Synthetic polypeptide
  XENP024131 avelumab[PD-L1]_H1L1_Fab-[anti-ICOS]_H0L0_scFv Fab-Fc Heavy Chain

SEQ ID NO: 29850 - protein, 483 aa, Artificial Sequence; identical to SEQ ID NO: 26827
  Description of Artificial Sequence: Synthetic polypeptide
  XENP024131 avelumab[PD-L1]_H1L1_Fab-[anti-ICOS]_H0L0_scFv scFv-Fc Heavy Chain

SEQ ID NO: 29851 - protein, 216 aa, Artificial Sequence; identical to SEQ ID NO: 27172
  Description of Artificial Sequence: Synthetic polypeptide
  XENP024131 avelumab[PD-L1]_H1L1_Fab-[anti-ICOS]_H0L0_scFv Light Chain

SEQ ID NO: 29852 - protein, 721 aa, Artificial Sequence; identical to SEQ ID NO: 27177
  Description of Artificial Sequence: Synthetic polypeptide
  XENP024124 durvalumab[PD-L1]_H1L1_Fab_(G4S)2_[anti-ICOS]_H0L0_ scFv20_Fc_IgG1 Heavy Chain

SEQ ID NO: 29853 - protein, 215 aa, Artificial Sequence; identical to SEQ ID NO: 27152
  Description of Artificial Sequence: Synthetic polypeptide
  XENP024124 durvalumab[PD-L1]_H1L1_Fab_(G4S)2_[anti-ICOS]_H0L0_ scFv20_Fc_IgG1 Light Chain

SEQ ID NO: 29854 - protein, 454 aa, Artificial Sequence; identical to SEQ ID NO: 26442
  Description of Artificial Sequence: Synthetic polypeptide
  XENP020266 [ICOS]_H0L0 one-arm mAb Fab-Fc Heavy Chain

SEQ ID NO: 29855 - protein, 231 aa, Artificial Sequence; identical to SEQ ID NO: 27198
  Description of Artificial Sequence: Synthetic polypeptide
  XENP020266 [ICOS]_H0L0 one-arm mAb Fc-only Heavy Chain

SEQ ID NO: 29856 - protein, 214 aa, Artificial Sequence; identical to SEQ ID NO: 26297
  Description of Artificial Sequence: Synthetic polypeptide
  XENP020266 [ICOS]_H0L0 one-arm mAb Light Chain

SEQ ID NO: 29857 - protein, 452 aa, Artificial Sequence; identical to SEQ ID NO: 26682
  Description of Artificial Sequence: Synthetic polypeptide
  XENP021861 GSK_314.8[ICOS]_H0L0 one-arm mAb Fab-Fc Heavy Chain

SEQ ID NO: 29858 - protein, 231 aa, Artificial Sequence; identical to SEQ ID NO: 27198
  Description of Artificial Sequence: Synthetic polypeptide
  XENP021861 GSK_314.8[ICOS]_H0L0 one-arm mAb Fc-only Heavy Chain

SEQ ID NO: 29859 - protein, 219 aa, Artificial Sequence; identical to SEQ ID NO: 26307
  Description of Artificial Sequence: Synthetic polypeptide
  XENP021861 GSK_314.8[ICOS]_H0L0 one-arm mAb Light Chain

SEQ ID NO: 29860 - protein, 454 aa, Artificial Sequence; identical to SEQ ID NO: 26722
  Description of Artificial Sequence: Synthetic polypeptide
  XENP021863 jMab-138[ICOS]_H0L0 one-arm mAb Fab-Fc Heavy Chain

SEQ ID NO: 29861 - protein, 231 aa, Artificial Sequence; identical to SEQ ID NO: 27198
  Description of Artificial Sequence: Synthetic polypeptide
  XENP021863 jMab-138[ICOS]_H0L0 one-arm mAb Fc-only Heavy Chain

SEQ ID NO: 29862 - protein, 216 aa, Artificial Sequence; identical to SEQ ID NO: 26327
  Description of Artificial Sequence: Synthetic polypeptide
  XENP021863 jMab-138[ICOS]_H0L0 one-arm mAb Light Chain

SEQ ID NO: 29863 - protein, 450 aa, Artificial Sequence; identical to SEQ ID NO: 26762
  Description of Artificial Sequence: Synthetic polypeptide
  XENP022349 WO2016059602[ICOS]_GSK_H0L0 one-arm mAb Fab-Fc Heavy Chain

SEQ ID NO: 29864 - protein, 231 aa, Artificial Sequence; identical to SEQ ID NO: 27198
  Description of Artificial Sequence: Synthetic polypeptide
  XENP022349 WO2016059602[ICOS]_GSK_H0L0 one-arm mAb Fc-only Heavy Chain

SEQ ID NO: 29865 - protein, 213 aa, Artificial Sequence; identical to SEQ ID NO: 26347
  Description of Artificial Sequence: Synthetic polypeptide
  XENP022349 WO2016059602[ICOS]_GSK_H0L0 one-arm mAb Light Chain

SEQ ID NO: 29866 - protein, 454 aa, Artificial Sequence; identical to SEQ ID NO: 26442
  Description of Artificial Sequence: Synthetic polypeptide
  XENP022439 [ICOS]_H0_L0.5 one-arm mAb Fab-Fc Heavy Chain

SEQ ID NO: 29867 - protein, 231 aa, Artificial Sequence; identical to SEQ ID NO: 27198
  Description of Artificial Sequence: Synthetic polypeptide
  XENP022439 [ICOS]_H0_L0.5 one-arm mAb Fc-only Heavy Chain

SEQ ID NO: 29868 - protein, 214 aa, Artificial Sequence; identical to SEQ ID NO: 27243
  Description of Artificial Sequence: Synthetic polypeptide
  XENP022439 [ICOS]_H0_L0.5 one-arm mAb Light Chain

SEQ ID NO: 29869 - protein, 454 aa, Artificial Sequence; identical to SEQ ID NO: 26442
  Description of Artificial Sequence: Synthetic polypeptide
  XENP022440 [ICOS]_H0_L0.7 one-arm mAb Fab-Fc Heavy Chain

SEQ ID NO: 29870 - protein, 231 aa, Artificial Sequence; identical to SEQ ID NO: 27198
  Description of Artificial Sequence: Synthetic polypeptide
  XENP022440 [ICOS]_H0_L0.7 one-arm mAb Fc-only Heavy Chain

SEQ ID NO: 29871 - protein, 214 aa, Artificial Sequence; identical to SEQ ID NO: 26477
  Description of Artificial Sequence: Synthetic polypeptide
  XENP022440 [ICOS]_H0_L0.7 one-arm mAb Light Chain

SEQ ID NO: 29872 - protein, 454 aa, Artificial Sequence; identical to SEQ ID NO: 26442
  Description of Artificial Sequence: Synthetic polypeptide
  XENP022441 [ICOS]_H0_L0.9 one-arm mAb Fab-Fc Heavy Chain

SEQ ID NO: 29873 - protein, 231 aa, Artificial Sequence; identical to SEQ ID NO: 27198
  Description of Artificial Sequence: Synthetic polypeptide
  XENP022441 [ICOS]_H0_L0.9 one-arm mAb Fc-only Heavy Chain

SEQ ID NO: 29874 - protein, 214 aa, Artificial Sequence; identical to SEQ ID NO: 27265
  Description of Artificial Sequence: Synthetic polypeptide
  XENP022441 [ICOS]_H0_L0.9 one-arm mAb Light Chain

SEQ ID NO: 29875 - protein, 454 aa, Artificial Sequence; identical to SEQ ID NO: 26442
  Description of Artificial Sequence: Synthetic polypeptide
  XENP022442 [ICOS]_H0_L0.10 one-arm mAb Fab-Fc Heavy Chain

SEQ ID NO: 29876 - protein, 231 aa, Artificial Sequence; identical to SEQ ID NO: 27198
  Description of Artificial Sequence: Synthetic polypeptide
  XENP022442 [ICOS]_H0_L0.10 one-arm mAb Fc-only Heavy Chain

SEQ ID NO: 29877 - protein, 214 aa, Artificial Sequence; identical to SEQ ID NO: 27276
  Description of Artificial Sequence: Synthetic polypeptide
  XENP022442 [ICOS]_H0_L0.10 one-arm mAb Light Chain

SEQ ID NO: 29878 - protein, 454 aa, Artificial Sequence; identical to SEQ ID NO: 26442
  Description of Artificial Sequence: Synthetic polypeptide
  XENP022443 [ICOS]_H0_L0.14 one-arm mAb Fab-Fc Heavy Chain

SEQ ID NO: 29879 - protein, 231 aa, Artificial Sequence; identical to SEQ ID NO: 27198
  Description of Artificial Sequence: Synthetic polypeptide
  XENP022443 [ICOS]_H0_L0.14 one-arm mAb Fc-only Heavy Chain

SEQ ID NO: 29880 - protein, 214 aa, Artificial Sequence; identical to SEQ ID NO: 27287
  Description of Artificial Sequence: Synthetic polypeptide
  XENP022443 [ICOS]_H0_L0.14 one-arm mAb Light Chain

SEQ ID NO: 29881 - protein, 454 aa, Artificial Sequence; identical to SEQ ID NO: 26442
  Description of Artificial Sequence: Synthetic polypeptide
  XENP022444 [ICOS]_H0_L0.15 one-arm mAb Fab-Fc Heavy Chain

SEQ ID NO: 29882 - protein, 231 aa, Artificial Sequence; identical to SEQ ID NO: 27198
  Description of Artificial Sequence: Synthetic polypeptide
  XENP022444 [ICOS]_H0_L0.15 one-arm mAb Fc-only Heavy Chain

SEQ ID NO: 29883 - protein, 214 aa, Artificial Sequence; identical to SEQ ID NO: 27298
  Description of Artificial Sequence: Synthetic polypeptide
  XENP022444 [ICOS]_H0_L0.15 one-arm mAb Light Chain

SEQ ID NO: 29884 - protein, 454 aa, Artificial Sequence; identical to SEQ ID NO: 26442
  Description of Artificial Sequence: Synthetic polypeptide
  XENP022445 [ICOS]_H0_L0.20 one-arm mAb Fab-Fc Heavy Chain

SEQ ID NO: 29885 - protein, 231 aa, Artificial Sequence; identical to SEQ ID NO: 27198
  Description of Artificial Sequence: Synthetic polypeptide
  XENP022445 [ICOS]_H0_L0.20 one-arm mAb Fc-only Heavy Chain

SEQ ID NO: 29886 - protein, 214 aa, Artificial Sequence; identical to SEQ ID NO: 27309
  Description of Artificial Sequence: Synthetic polypeptide
  XENP022445 [ICOS]_H0_L0.20 one-arm mAb Light Chain

SEQ ID NO: 29887 - protein, 454 aa, Artificial Sequence; identical to SEQ ID NO: 26442
  Description of Artificial Sequence: Synthetic polypeptide
  XENP022766 [ICOS]_H0_L0.38 one-arm mAb Fab-Fc Heavy Chain

SEQ ID NO: 29888 - protein, 231 aa, Artificial Sequence; identical to SEQ ID NO: 27198
  Description of Artificial Sequence: Synthetic polypeptide
  XENP022766 [ICOS]_H0_L0.38 one-arm mAb Fc-only Heavy Chain

SEQ ID NO: 29889 - protein, 214 aa, Artificial Sequence; identical to SEQ ID NO: 26557
  Description of Artificial Sequence: Synthetic polypeptide
  XENP022766 [ICOS]_H0_L0.38 one-arm mAb Light Chain

SEQ ID NO: 29890 - protein, 454 aa, Artificial Sequence; identical to SEQ ID NO: 26562
  Description of Artificial Sequence: Synthetic polypeptide
  XENP023096 [ICOS]_H0.66_L0 one-arm mAb Fab-Fc Heavy Chain

SEQ ID NO: 29891 - protein, 231 aa, Artificial Sequence; identical to SEQ ID NO: 27198
  Description of Artificial Sequence: Synthetic polypeptide
  XENP023096 [ICOS]_H0.66_L0 one-arm mAb Fc-only Heavy Chain

SEQ ID NO: 29892 - protein, 214 aa, Artificial Sequence; identical to SEQ ID NO: 26297
  Description of Artificial Sequence: Synthetic polypeptide
  XENP023096 [ICOS]_H0.66_L0 one-arm mAb Light Chain

SEQ ID NO: 29893 - protein, 447 aa, Artificial Sequence; identical to SEQ ID NO: 26382
  Description of Artificial Sequence: Synthetic polypeptide
  XENP023377 11D4[OX40]_H0L0_Fab-1G6_L1.194_H1.279_scFv Fab-Fc Heavy Chain

SEQ ID NO: 29894 - protein, 480 aa, Artificial Sequence; identical to SEQ ID NO: 2870
  Description of Artificial Sequence: Synthetic polypeptide
  XENP023377 11D4[OX40]_H0L0_Fab-1G6_L1.194_H1.279_scFv scFv-Fc Heavy Chain

SEQ ID NO: 29895 - protein, 214 aa, Artificial Sequence; identical to SEQ ID NO: 26277
  Description of Artificial Sequence: Synthetic polypeptide
  XENP023377 11D4[OX40]_H0L0_Fab-1G6_L1.194_H1.279_scFv Light Chain

SEQ ID NO: 29896 - protein, 451 aa, Artificial Sequence; identical to SEQ ID NO: 26402
  Description of Artificial Sequence: Synthetic polypeptide
  XENP023378 1D8[GITR]_H0L0_Fab-1G6_L1.194_H1.279_scFv Fab-Fc Heavy Chain

SEQ ID NO: 29897 - protein, 480 aa, Artificial Sequence; identical to SEQ ID NO: 2870
  Description of Artificial Sequence: Synthetic polypeptide
  XENP023378 1D8[GITR]_H0L0_Fab-1G6_L1.194_H1.279_scFv scFv-Fc Heavy Chain

SEQ ID NO: 29898 - protein, 219 aa, Artificial Sequence; identical to SEQ ID NO: 26287
  Description of Artificial Sequence: Synthetic polypeptide
  XENP023378 1D8[GITR]_H0L0_Fab-1G6_L1.194_H1.279_scFv Light Chain

SEQ ID NO: 29899 - protein, 450 aa, Artificial Sequence; identical to SEQ ID NO: 26422
  Description of Artificial Sequence: Synthetic polypeptide
  XENP023379 20H4.9[4-1BB]_H0L0_Fab-1G6_L1.194_H1.279_scFv Fab -Fc Heavy Chain

SEQ ID NO: 29900 - protein, 480 aa, Artificial Sequence; identical to SEQ ID NO: 2870
  Description of Artificial Sequence: Synthetic polypeptide
  XENP023379 20H4.9[4-1BB]_H0L0_Fab-1G6_L1.194_H1.279_scFv scFv -Fc Heavy Chain

SEQ ID NO: 29901 - protein, 216 aa, Artificial Sequence; identical to SEQ ID NO: 26267
  Description of Artificial Sequence: Synthetic polypeptide
  XENP023379 20H4.9[4-1BB]_H0L0_Fab-1G6_L1.194_H1.279_scFv Light Chain

SEQ ID NO: 29902 - protein, 447 aa, Artificial Sequence; identical to SEQ ID NO: 27396
  Description of Artificial Sequence: Synthetic polypeptide
  XENP019192 ipilimumab[CTLA-4]_H0L0_Fab-[anti-ICOS]-H0L0_scFv Fab-Fc Heavy Chain

SEQ ID NO: 29903 - protein, 483 aa, Artificial Sequence; identical to SEQ ID NO: 26827
  Description of Artificial Sequence: Synthetic polypeptide
  XENP019192 ipilimumab[CTLA-4]_H0L0_Fab-[anti-ICOS]-H0L0_scFv scFv-Fc Heavy Chain

SEQ ID NO: 29904 - protein, 215 aa, Artificial Sequence; identical to SEQ ID NO: 7600
  Description of Artificial Sequence: Synthetic polypeptide
  XENP019192 ipilimumab[CTLA-4]_H0L0_Fab-[anti-ICOS]-H0L0_scFv Light Chain

SEQ ID NO: 29905 - protein, 450 aa, Artificial Sequence; identical to SEQ ID NO: 26262
  Description of Artificial Sequence: Synthetic polypeptide
  XENP014410 20H4.9[4-1BB]_H0L0_IgG1_PVA_/S267K Heavy Chain

SEQ ID NO: 29906 - protein, 216 aa, Artificial Sequence; identical to SEQ ID NO: 26267
  Description of Artificial Sequence: Synthetic polypeptide
  XENP014410 20H4.9[4-1BB]_H0L0_IgG1_PVA_/S267K Light Chain

SEQ ID NO: 29907 - protein, 447 aa, Artificial Sequence; identical to SEQ ID NO: 26272
  Description of Artificial Sequence: Synthetic polypeptide
  XENP016437 11D4[OX40]_H0L0_IgG1_PVA_/S267K Heavy Chain

SEQ ID NO: 29908 - protein, 214 aa, Artificial Sequence; identical to SEQ ID NO: 26277
  Description of Artificial Sequence: Synthetic polypeptide
  XENP016437 11D4[OX40]_H0L0_IgG1_PVA_/S267K Light Chain

SEQ ID NO: 29909 - protein, 451 aa, Artificial Sequence; identical to SEQ ID NO: 26282
  Description of Artificial Sequence: Synthetic polypeptide
  XENP016438 1D8[GITR]_H0L0_IgG1_PVA_/S267K Heavy Chain

SEQ ID NO: 29910 - protein, 219 aa, Artificial Sequence; identical to SEQ ID NO: 26287
  Description of Artificial Sequence: Synthetic polypeptide
  XENP016438 1D8[GITR]_H0L0_IgG1_PVA_/S267K Light Chain

SEQ ID NO: 29911 - protein, 452 aa, Artificial Sequence; identical to SEQ ID NO: 26302
  Description of Artificial Sequence: Synthetic polypeptide
  XENP021820 GSK_314.8[ICOS]_H0L0_IgG1_PVA_/S267K Heavy Chain

SEQ ID NO: 29912 - protein, 219 aa, Artificial Sequence; identical to SEQ ID NO: 26307
  Description of Artificial Sequence: Synthetic polypeptide
  XENP021820 GSK_314.8[ICOS]_H0L0_IgG1_PVA_/S267K Light Chain

SEQ ID NO: 29913 - protein, 453 aa, Artificial Sequence; identical to SEQ ID NO: 26312
  Description of Artificial Sequence: Synthetic polypeptide
  XENP021821 GSK_88.2[ICOS]_H0L0_IgG1_PVA_/S267K Heavy Chain

SEQ ID NO: 29914 - protein, 219 aa, Artificial Sequence; identical to SEQ ID NO: 26317
  Description of Artificial Sequence: Synthetic polypeptide
  XENP021821 GSK_88.2[ICOS]_H0L0_IgG1_PVA_/S267K Light Chain

SEQ ID NO: 29915 - protein, 454 aa, Artificial Sequence; identical to SEQ ID NO: 26322
  Description of Artificial Sequence: Synthetic polypeptide
  XENP021822 jMab-138[ICOS]_H0L0_IgG1_PVA_/S267K Heavy Chain

SEQ ID NO: 29916 - protein, 216 aa, Artificial Sequence; identical to SEQ ID NO: 26327
  Description of Artificial Sequence: Synthetic polypeptide
  XENP021822 jMab-138[ICOS]_H0L0_IgG1_PVA_/S267K Light Chain

SEQ ID NO: 29917 - protein, 454 aa, Artificial Sequence; identical to SEQ ID NO: 26332
  Description of Artificial Sequence: Synthetic polypeptide
  XENP021823 jMab-139[ICOS]_H0L0_IgG1_PVA_/S267K Heavy Chain

SEQ ID NO: 29918 - protein, 216 aa, Artificial Sequence; identical to SEQ ID NO: 26337
  Description of Artificial Sequence: Synthetic polypeptide
  XENP021823 jMab-139[ICOS]_H0L0_IgG1_PVA_/S267K Light Chain

SEQ ID NO: 29919 - protein, 450 aa, Artificial Sequence; identical to SEQ ID NO: 26342
  Description of Artificial Sequence: Synthetic polypeptide
  XENP022346 WO2016059602_GSK[ICOS]_H0L0_IgG1_PVA_/S267K Heavy Chain

SEQ ID NO: 29920 - protein, 213 aa, Artificial Sequence; identical to SEQ ID NO: 26347
  Description of Artificial Sequence: Synthetic polypeptide
  XENP022346 WO2016059602_GSK[ICOS]_H0L0_IgG1_PVA_/S267K Light Chain

SEQ ID NO: 29921 - protein, 446 aa, Artificial Sequence; identical to SEQ ID NO: 26352
  Description of Artificial Sequence: Synthetic polypeptide
  XENP023057 Jounce_37A10S713[ICOS]_H0L0_IgG1_PVA_/S267K Heavy Chain

SEQ ID NO: 29922 - protein, 218 aa, Artificial Sequence; identical to SEQ ID NO: 26357
  Description of Artificial Sequence: Synthetic polypeptide
  XENP023057 Jounce_37A10S713[ICOS]_H0L0_IgG1_PVA_/S267K Light Chain

SEQ ID NO: 29923 - protein, 447 aa, Artificial Sequence; identical to SEQ ID NO: 27506
  Description of Artificial Sequence: Synthetic polypeptide
  XENP016434 YW243.55.S70[PD-L1]_H0L0_IgG1_PVA_/S267K Heavy Chain

SEQ ID NO: 29924 - protein, 214 aa, Artificial Sequence; identical to SEQ ID NO: 27132
  Description of Artificial Sequence: Synthetic polypeptide
  XENP016434 YW243.55.S70[PD-L1]_H0L0_IgG1_PVA_/S267K Light Chain

SEQ ID NO: 29925 - protein, 449 aa, Artificial Sequence; identical to SEQ ID NO: 27516
  Description of Artificial Sequence: Synthetic polypeptide
  XENP024118 avelumab[PD-L1]_H1L1_IgG1_PVA_/S267K Heavy Chain

SEQ ID NO: 29926 - protein, 216 aa, Artificial Sequence; identical to SEQ ID NO: 27172
  Description of Artificial Sequence: Synthetic polypeptide
  XENP024118 avelumab[PD-L1]_H1L1_IgG1_PVA_/S267K Light Chain

SEQ ID NO: 29927 - protein, 450 aa, Artificial Sequence; identical to SEQ ID NO: 27526
  Description of Artificial Sequence: Synthetic polypeptide
  XENP024119 durvalumab[PD-L1]_H1L1_IgG1_PVA_/S267K Heavy Chain

SEQ ID NO: 29928 - protein, 215 aa, Artificial Sequence; identical to SEQ ID NO: 27152
  Description of Artificial Sequence: Synthetic polypeptide
  XENP024119 durvalumab[PD-L1]_H1L1_IgG1_PVA_/S267K Light Chain

SEQ ID NO: 29929 - protein, 456 aa, Artificial Sequence; identical to SEQ ID NO: 27536
  Description of Artificial Sequence: Synthetic polypeptide
  XENP024120 LOPD180[PD-1]_H1L1_IgG1_PVA_/S267K Heavy Chain

SEQ ID NO: 29930 - protein, 216 aa, Artificial Sequence; identical to SEQ ID NO: 26837
  Description of Artificial Sequence: Synthetic polypeptide
  XENP024120 LOPD180[PD-1]_H1L1_IgG1_PVA_/S267K Light Chain

SEQ ID NO: 29931 - protein, 448 aa, Artificial Sequence; identical to SEQ ID NO: 27546
  Description of Artificial Sequence: Synthetic polypeptide
  XENP024121 mAb7(1.2)[PD-1]_H1L1_IgG1_PVA_/S267K Heavy Chain

SEQ ID NO: 29932 - protein, 218 aa, Artificial Sequence; identical to SEQ ID NO: 27551
  Description of Artificial Sequence: Synthetic polypeptide
  XENP024121 mAb7(1.2)[PD-1]_H1L1_IgG1_PVA_/S267K Light Chain

SEQ ID NO: 29933 - protein, 452 aa, Artificial Sequence; identical to SEQ ID NO: 26682
  Description of Artificial Sequence: Synthetic polypeptide
  XENP021832 GSK_314.8[ICOS]_H0L0_Fab-YW243.55.S70[PD-L1]_H0L0_ scFv Fab-Fc Heavy Chain

SEQ ID NO: 29934 - protein, 471 aa, Artificial Sequence; identical to SEQ ID NO: 27561
  Description of Artificial Sequence: Synthetic polypeptide
  XENP021832 GSK_314.8[ICOS]_H0L0_Fab-YW243.55.S70[PD-L1]_H0L0_ scFv scFv-Fc Heavy Chain

SEQ ID NO: 29935 - protein, 219 aa, Artificial Sequence; identical to SEQ ID NO: 26307
  Description of Artificial Sequence: Synthetic polypeptide
  XENP021832 GSK_314.8[ICOS]_H0L0_Fab-YW243.55.S70[PD-L1]_H0L0_ scFv Light Chain

SEQ ID NO: 29936 - protein, 453 aa, Artificial Sequence; identical to SEQ ID NO: 26702
  Description of Artificial Sequence: Synthetic polypeptide
  XENP021833 GSK_88.2[ICOS]_H0L0_Fab-YW243.55.S70[PD-L1]_H0L0_scFv Fab-Fc Heavy Chain

SEQ ID NO: 29937 - protein, 471 aa, Artificial Sequence; identical to SEQ ID NO: 27561
  Description of Artificial Sequence: Synthetic polypeptide
  XENP021833 GSK_88.2[ICOS]_H0L0_Fab-YW243.55.S70[PD-L1]_H0L0_scFv scFv-Fc Heavy Chain

SEQ ID NO: 29938 - protein, 219 aa, Artificial Sequence; identical to SEQ ID NO: 26317
  Description of Artificial Sequence: Synthetic polypeptide
  XENP021833 GSK_88.2[ICOS]_H0L0_Fab-YW243.55.S70[PD-L1]_H0L0_scFv Light Chain

SEQ ID NO: 29939 - protein, 454 aa, Artificial Sequence; identical to SEQ ID NO: 26722
  Description of Artificial Sequence: Synthetic polypeptide
  XENP021834 jMab-138[ICOS]_H0L0_Fab-YW243.55.S70[PD-L1]_H0L0_scFv Fab-Fc Heavy Chain

SEQ ID NO: 29940 - protein, 471 aa, Artificial Sequence; identical to SEQ ID NO: 27561
  Description of Artificial Sequence: Synthetic polypeptide
  XENP021834 jMab-138[ICOS]_H0L0_Fab-YW243.55.S70[PD-L1]_H0L0_scFv scFv-Fc Heavy Chain

SEQ ID NO: 29941 - protein, 216 aa, Artificial Sequence; identical to SEQ ID NO: 26327
  Description of Artificial Sequence: Synthetic polypeptide
  XENP021834 jMab-138[ICOS]_H0L0_Fab-YW243.55.S70[PD-L1]_H0L0_scFv Light Chain

SEQ ID NO: 29942 - protein, 454 aa, Artificial Sequence; identical to SEQ ID NO: 26742
  Description of Artificial Sequence: Synthetic polypeptide
  XENP021835 jMab-139[ICOS]_H0L0_Fab-YW243.55.S70[PD-L1]_H0L0_scFv Fab-Fc Heavy Chain

SEQ ID NO: 29943 - protein, 471 aa, Artificial Sequence; identical to SEQ ID NO: 27561
  Description of Artificial Sequence: Synthetic polypeptide
  XENP021835 jMab-139[ICOS]_H0L0_Fab-YW243.55.S70[PD-L1]_H0L0_scFv scFv-Fc Heavy Chain

SEQ ID NO: 29944 - protein, 216 aa, Artificial Sequence; identical to SEQ ID NO: 26337
  Description of Artificial Sequence: Synthetic polypeptide
  XENP021835 jMab-139[ICOS]_H0L0_Fab-YW243.55.S70[PD-L1]_H0L0_scFv Light Chain

SEQ ID NO: 29945 - protein, 454 aa, Artificial Sequence; identical to SEQ ID NO: 26442
  Description of Artificial Sequence: Synthetic polypeptide
  XENP021836 jMab-136[ICOS]_H0L0_Fab-YW243.55.S70[PD-L1]_H0L0_scFv Fab-Fc Heavy Chain

SEQ ID NO: 29946 - protein, 471 aa, Artificial Sequence; identical to SEQ ID NO: 27561
  Description of Artificial Sequence: Synthetic polypeptide
  XENP021836 jMab-136[ICOS]_H0L0_Fab-YW243.55.S70[PD-L1]_H0L0_scFv scFv-Fc Heavy Chain

SEQ ID NO: 29947 - protein, 214 aa, Artificial Sequence; identical to SEQ ID NO: 26297
  Description of Artificial Sequence: Synthetic polypeptide
  XENP021836 jMab-136[ICOS]_H0L0_Fab-YW243.55.S70[PD-L1]_H0L0_scFv Light Chain

SEQ ID NO: 29948 - protein, 442 aa, Artificial Sequence; identical to SEQ ID NO: 26802
  Description of Artificial Sequence: Synthetic polypeptide
  XENP018920 nivolumab[PD-1]_H0L0_Fab-[anti-ICOS]_H0L0_scFv Fab-Fc Heavy Chain

SEQ ID NO: 29949 - protein, 471 aa, Artificial Sequence; identical to SEQ ID NO: 26807
  Description of Artificial Sequence: Synthetic polypeptide
  XENP018920 nivolumab[PD-1]_H0L0_Fab-[anti-ICOS]_H0L0_scFv scFv-Fc Heavy Chain

SEQ ID NO: 29950 - protein, 214 aa, Artificial Sequence; identical to SEQ ID NO: 16146
  Description of Artificial Sequence: Synthetic polypeptide
  XENP018920 nivolumab[PD-1]_H0L0_Fab-[anti-ICOS]_H0L0_scFv Light Chain

SEQ ID NO: 29951 - protein, 456 aa, Artificial Sequence; identical to SEQ ID NO: 26822
  Description of Artificial Sequence: Synthetic polypeptide
  XENP024130 LOPD180[PD-1]_H1L1_Fab-[anti-ICOS]_H0L0_scFv Fab-Fc Heavy Chain

SEQ ID NO: 29952 - protein, 483 aa, Artificial Sequence; identical to SEQ ID NO: 26827
  Description of Artificial Sequence: Synthetic polypeptide
  XENP024130 LOPD180[PD-1]_H1L1_Fab-[anti-ICOS]_H0L0_scFv scFv-Fc Heavy Chain

SEQ ID NO: 29953 - protein, 216 aa, Artificial Sequence; identical to SEQ ID NO: 26837
  Description of Artificial Sequence: Synthetic polypeptide
  XENP024130 LOPD180[PD-1]_H1L1_Fab-[anti-ICOS]_H0L0_scFv Light Chain

SEQ ID NO: 29954 - protein, 452 aa, Artificial Sequence; identical to SEQ ID NO: 26682
  Description of Artificial Sequence: Synthetic polypeptide
  XENP021828 GSK_314.8[ICOS]_H0L0_Fab-1G6_L1.194_H1.279_scFv Fab-Fc Heavy Chain

SEQ ID NO: 29955 - protein, 480 aa, Artificial Sequence; identical to SEQ ID NO: 2870
  Description of Artificial Sequence: Synthetic polypeptide
  XENP021828 GSK_314.8[ICOS]_H0L0_Fab-1G6_L1.194_H1.279_scFv scFv-Fc Heavy Chain

SEQ ID NO: 29956 - protein, 219 aa, Artificial Sequence; identical to SEQ ID NO: 26307
  Description of Artificial Sequence: Synthetic polypeptide
  XENP021828 GSK_314.8[ICOS]_H0L0_Fab-1G6_L1.194_H1.279_scFv Light Chain

SEQ ID NO: 29957 - protein, 453 aa, Artificial Sequence; identical to SEQ ID NO: 26702
  Description of Artificial Sequence: Synthetic polypeptide
  XENP021829 GSK_88.2[ICOS]_H0L0_Fab-1G6_L1.194_H1.279_scFv Fab-Fc Heavy Chain

SEQ ID NO: 29958 - protein, 480 aa, Artificial Sequence; identical to SEQ ID NO: 2870
  Description of Artificial Sequence: Synthetic polypeptide
  XENP021829 GSK_88.2[ICOS]_H0L0_Fab-1G6_L1.194_H1.279_scFv scFv-Fc Heavy Chain

SEQ ID NO: 29959 - protein, 219 aa, Artificial Sequence; identical to SEQ ID NO: 26317
  Description of Artificial Sequence: Synthetic polypeptide
  XENP021829 GSK_88.2[ICOS]_H0L0_Fab-1G6_L1.194_H1.279_scFv Light Chain

SEQ ID NO: 29960 - protein, 454 aa, Artificial Sequence; identical to SEQ ID NO: 26722
  Description of Artificial Sequence: Synthetic polypeptide
  XENP021830 jMab-138[ICOS]_H0L0_Fab-1G6_L1.194_H1.279_scFv Fab-Fc Heavy Chain

SEQ ID NO: 29961 - protein, 480 aa, Artificial Sequence; identical to SEQ ID NO: 2870
  Description of Artificial Sequence: Synthetic polypeptide
  XENP021830 jMab-138[ICOS]_H0L0_Fab-1G6_L1.194_H1.279_scFv scFv-Fc Heavy Chain

SEQ ID NO: 29962 - protein, 216 aa, Artificial Sequence; identical to SEQ ID NO: 26327
  Description of Artificial Sequence: Synthetic polypeptide
  XENP021830 jMab-138[ICOS]_H0L0_Fab-1G6_L1.194_H1.279_scFv Light Chain

SEQ ID NO: 29963 - protein, 454 aa, Artificial Sequence; identical to SEQ ID NO: 26742
  Description of Artificial Sequence: Synthetic polypeptide
  XENP021831 jMab-139[ICOS]_H0L0_Fab-1G6_L1.194_H1.279_scFv Fab-Fc Heavy Chain

SEQ ID NO: 29964 - protein, 480 aa, Artificial Sequence; identical to SEQ ID NO: 2870
  Description of Artificial Sequence: Synthetic polypeptide
  XENP021831 jMab-139[ICOS]_H0L0_Fab-1G6_L1.194_H1.279_scFv scFv-Fc Heavy Chain

SEQ ID NO: 29965 - protein, 216 aa, Artificial Sequence; identical to SEQ ID NO: 26337
  Description of Artificial Sequence: Synthetic polypeptide
  XENP021831 jMab-139[ICOS]_H0L0_Fab-1G6_L1.194_H1.279_scFv Light Chain

SEQ ID NO: 29966 - protein, 450 aa, Artificial Sequence; identical to SEQ ID NO: 26762
  Description of Artificial Sequence: Synthetic polypeptide
  XENP022348 WO2016059602_GSK_H0L0_Fab-1G6_L1.194_H1.279_scFv Fab-Fc Heavy Chain

SEQ ID NO: 29967 - protein, 480 aa, Artificial Sequence; identical to SEQ ID NO: 2870
  Description of Artificial Sequence: Synthetic polypeptide
  XENP022348 WO2016059602_GSK_H0L0_Fab-1G6_L1.194_H1.279_scFv scFv-Fc Heavy Chain

SEQ ID NO: 29968 - protein, 213 aa, Artificial Sequence; identical to SEQ ID NO: 26347
  Description of Artificial Sequence: Synthetic polypeptide
  XENP022348 WO2016059602_GSK_H0L0_Fab-1G6_L1.194_H1.279_scFv Light Chain

SEQ ID NO: 29969 - protein, 447 aa, Artificial Sequence; identical to SEQ ID NO: 27117
  Description of Artificial Sequence: Synthetic polypeptide
  XENP021748 YW243.55.S70[PD-L1]_H0L0_Fab-[anti-ICOS]_H0L0_scFv Fab-Fc Heavy Chain

SEQ ID NO: 29970 - protein, 483 aa, Artificial Sequence; identical to SEQ ID NO: 26827
  Description of Artificial Sequence: Synthetic polypeptide
  XENP021748 YW243.55.S70[PD-L1]_H0L0_Fab-[anti-ICOS]_H0L0_scFv scFv-Fc Heavy Chain

SEQ ID NO: 29971 - protein, 214 aa, Artificial Sequence; identical to SEQ ID NO: 27132
  Description of Artificial Sequence: Synthetic polypeptide
  XENP021748 YW243.55.S70[PD-L1]_H0L0_Fab-[anti-ICOS]_H0L0_scFv Light Chain

SEQ ID NO: 29972 - protein, 454 aa, Artificial Sequence; identical to SEQ ID NO: 26442
  Description of Artificial Sequence: Synthetic polypeptide
  XENP021749 [anti-ICOS]_H0L0_Fab-[anti-CTLA-4]_H3.23_L0.129_scFv Fab-Fc Heavy Chain

SEQ ID NO: 29973 - protein, 477 aa, Artificial Sequence; identical to SEQ ID NO: 2394
  Description of Artificial Sequence: Synthetic polypeptide
  XENP021749 [anti-ICOS]_H0L0_Fab-[anti-CTLA-4]_H3.23_L0.129_scFv scFv-Fc Heavy Chain

SEQ ID NO: 29974 - protein, 214 aa, Artificial Sequence; identical to SEQ ID NO: 26297
  Description of Artificial Sequence: Synthetic polypeptide
  XENP021749 [anti-ICOS]_H0L0_Fab-[anti-CTLA-4]_H3.23_L0.129_scFv Light Chain

SEQ ID NO: 29975 - protein, 452 aa, Artificial Sequence; identical to SEQ ID NO: 26682
  Description of Artificial Sequence: Synthetic polypeptide
  XENP021861 GSK_314.8[ICOS]_H0L0 one-arm mAb Fab-Fc Heavy Chain

SEQ ID NO: 29976 - protein, 231 aa, Artificial Sequence; identical to SEQ ID NO: 27198
  Description of Artificial Sequence: Synthetic polypeptide
  XENP021861 GSK_314.8[ICOS]_H0L0 one-arm mAb Fc-only Heavy Chain

SEQ ID NO: 29977 - protein, 219 aa, Artificial Sequence; identical to SEQ ID NO: 26307
  Description of Artificial Sequence: Synthetic polypeptide
  XENP021861 GSK_314.8[ICOS]_H0L0 one-arm mAb Light Chain

SEQ ID NO: 29978 - protein, 454 aa, Artificial Sequence; identical to SEQ ID NO: 26722
  Description of Artificial Sequence: Synthetic polypeptide
  XENP021863 jMab-138[ICOS]_H0L0 one-arm mAb Fab-Fc Heavy Chain

SEQ ID NO: 29979 - protein, 231 aa, Artificial Sequence; identical to SEQ ID NO: 27198
  Description of Artificial Sequence: Synthetic polypeptide
  XENP021863 jMab-138[ICOS]_H0L0 one-arm mAb Fc-only Heavy Chain

SEQ ID NO: 29980 - protein, 216 aa, Artificial Sequence; identical to SEQ ID NO: 26327
  Description of Artificial Sequence: Synthetic polypeptide
  XENP021863 jMab-138[ICOS]_H0L0 one-arm mAb Light Chain

SEQ ID NO: 29981 - protein, 450 aa, Artificial Sequence; identical to SEQ ID NO: 26762
  Description of Artificial Sequence: Synthetic polypeptide
  XENP022349 WO2016059602[ICOS]_GSK_H0L0 one-arm mAb Fab-Fc Heavy Chain

SEQ ID NO: 29982 - protein, 231 aa, Artificial Sequence; identical to SEQ ID NO: 27198
  Description of Artificial Sequence: Synthetic polypeptide
  XENP022349 WO2016059602[ICOS]_GSK_H0L0 one-arm mAb Fc-only Heavy Chain

SEQ ID NO: 29983 - protein, 213 aa, Artificial Sequence; identical to SEQ ID NO: 26347
  Description of Artificial Sequence: Synthetic polypeptide
  XENP022349 WO2016059602[ICOS]_GSK_H0L0 one-arm mAb Light Chain

SEQ ID NO: 29984 - protein, 329 aa, Artificial Sequence; identical to SEQ ID NO: 28669
  Description of Artificial Sequence: Synthetic polypeptide
  monomer 1 (Fab-scFv side)

SEQ ID NO: 29985 - protein, 329 aa, Artificial Sequence
  Description of Artificial Sequence: Synthetic polypeptide
  monomer 2 (Fab side)
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29986 - protein, 107 aa, Artificial Sequence [sequence omitted]

SEQ ID NO: 29987 - protein, 329 aa, Artificial Sequence; identical to SEQ ID NO: 28669
  Description of Artificial Sequence: Synthetic polypeptide
  Fab-scFv-Hc - 356D/358L allotype

SEQ ID NO: 29988 - protein, 329 aa, Artificial Sequence
  Description of Artificial Sequence: Synthetic polypeptide
  mAb-scFv Fab-Hc - 356D/358L allotype
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29989 - protein, 329 aa, Artificial Sequence; identical to SEQ ID NO: 28680
  Description of Artificial Sequence: Synthetic polypeptide
  mAb-scFv Fab-scFv-Hc - N297A

SEQ ID NO: 29990 - protein, 329 aa, Artificial Sequence
  Description of Artificial Sequence: Synthetic polypeptide
  mAb-scFv Fab-Hc - N297A
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29991 - protein, 329 aa, Artificial Sequence; identical to SEQ ID NO: 28682
  Description of Artificial Sequence: Synthetic polypeptide
  mAb-scFv Fab-scFv-Hc - N297S

SEQ ID NO: 29992 - protein, 329 aa, Artificial Sequence
  Description of Artificial Sequence: Synthetic polypeptide
  mAb-scFv Fab-Hc - N297S
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 29993 - protein, 327 aa, Artificial Sequence; identical to SEQ ID NO: 28684
  Description of Artificial Sequence: Synthetic polypeptide
  mAb-scFv Fab-scFv-IgG4-Hc

SEQ ID NO: 29994 - protein, 327 aa, Artificial Sequence
  Description of Artificial Sequence: Synthetic polypeptide
  mAb-scFv Fab-IgG4-Hc
ASTKGPSVFPLAPCSRSTSESTAALGCLVKDYFPEPVTVSWNSGALTSGVHTFPAVLQSSGLYSLSSVVTVPSSSLGTKTYTCNVDHKPSDTKVDKRVESKYGPPCPPCPAPEFLGGPSVFLFPPKPKDTLMISRTPEVTCVVVDVKQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 29995 - protein, 326 aa, Artificial Sequence; identical to SEQ ID NO: 28686
  Description of Artificial Sequence: Synthetic polypeptide
  mAb-scFv Fab-scFv-IgG2-Hc - without S267K

SEQ ID NO: 29996 - protein, 326 aa, Artificial Sequence
  Description of Artificial Sequence: Synthetic polypeptide
  mAb-scFv Fab-IgG2-Hc - without S267K
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 29997 - protein, 326 aa, Artificial Sequence; identical to SEQ ID NO: 28688
  Description of Artificial Sequence: Synthetic polypeptide
  mAb-scFv Fab-scFv-IgG2-Hc - with S267K

SEQ ID NO: 29998 - protein, 326 aa, Artificial Sequence
  Description of Artificial Sequence: Synthetic polypeptide
  mAb-scFv Fab-IgG2-Hc - with S267K
ASTKGPSVFPLAPCSRSTSESTAALGCLVKDYFPEPVTVSWNSGALTSGVHTFPAVLQSSGLYSLSSVVTVPSSNFGTQTYTCNVDHKPSDTKVDKTVERKCSVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 29999 - protein, 120 aa, Artificial Sequence [sequence omitted]

SEQ ID NO: 30000 - protein, 111 aa, Artificial Sequence [sequence omitted]

SEQ ID NO: 30001 - protein, 113 aa, Artificial Sequence [sequence omitted]

SEQ ID NO: 30002 - protein, 107 aa, Artificial Sequence [sequence omitted]

SEQ ID NO: 30003 - protein, 117 aa, Artificial Sequence
  Description of Artificial Sequence: Synthetic polypeptide
  Teva pidilizumab VH
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 30004 - protein, 106 aa, Artificial Sequence
  Description of Artificial Sequence: Synthetic polypeptide
  Teva pidilizumab VL
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 30005 - protein, 120 aa, Artificial Sequence [sequence omitted]

SEQ ID NO: 30006 - protein, 111 aa, Artificial Sequence [sequence omitted]

SEQ ID NO: 30007 - protein, 117 aa, Artificial Sequence
  Description of Artificial Sequence: Synthetic polypeptide
  Novartis/Dana Farber BAP049 clone E VH
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 30008 - protein, 113 aa, Artificial Sequence
  Description of Artificial Sequence: Synthetic polypeptide
  Novartis/Dana Farber BAP049 clone E VL
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 30009 - protein, 117 aa, Artificial Sequence; identical to SEQ ID NO: 30007
  Description of Artificial Sequence: Synthetic polypeptide
  Novartis/Dana Farber BAP049 clone B VH

SEQ ID NO: 30010 - protein, 113 aa, Artificial Sequence
  Description of Artificial Sequence: Synthetic polypeptide
  Novartis/Dana Farber BAP049 clone B VL
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 30011 - protein, 117 aa, Artificial Sequence [sequence omitted]

SEQ ID NO: 30012 - protein, 107 aa, Artificial Sequence [sequence omitted]

SEQ ID NO: 30013 - protein, 122 aa, Artificial Sequence
  Description of Artificial Sequence: Synthetic polypeptide
  Medimmune h1H3 Var 6 VH
EVQLVESGGGLVQPGGSLRLSCAASGFTFSDYGMHWVRQAPGKGLEWVAYISSGSYTIYYADSVKGRFTISRDNAKNTLYLQMSSLRAEDTAVYYCARRGYGSFYEYYFDYWGQGTTVTVSS

SEQ ID NO: 30014 - protein, 106 aa, Artificial Sequence
  Description of Artificial Sequence: Synthetic polypeptide
  Medimmune h1H3 Var 6 VL
QIVLTQSPATLSLSPGERATLSCSASSSVSYMYWYQQKPGQAPRLLIYLTSNRATGIPARFSGSGSGTDYTLTISSLEPEDFAVYYCQQWSSNPFTFGQGTKLEIK

SEQ ID NO: 30015 - protein, 116 aa, Artificial Sequence
  Description of Artificial Sequence: Synthetic polypeptide
  Tesarao TSR-042/APE2058 VH
EVQLLESGGGLVQPGGSLRLSCAASGFTFSSYDMSWVRQAPGKGLEWVSTISGGGSYTYYQDSVKGRFTISRDNSKNTLYLQMNSLRAEDTAVYYCASPYYAMDYWGQGTTVTVSS

SEQ ID NO: 30016 - protein, 107 aa, Artificial Sequence
  Description of Artificial Sequence: Synthetic polypeptide
  Tesarao TSR-042/APE2058 VL
DIQLTQSPSFLSAYVGDRVTITCKASQDVGTAVAWYQQKPGKAPKLLIYWASTLHTGVPSRFSGSGSGTEFTLTISSLQPEDFATYYCQHYSSYPWTFGQGTKLEIK

SEQ ID NO: 30017 - protein, 116 aa, Artificial Sequence
  Description of Artificial Sequence: Synthetic polypeptide
  Incyte Camrelizumab VH
EVQLVESGGGLVQPGGSLRLSCAASGFTFSSYMMSWVRQAPGKGLEWVATISGGGANTYYPDSVKGRFTISRDNAKNSLYLQMNSLRAEDTAVYYCARQLYYFDYWGQGTTVTVSS

SEQ ID NO: 30018 - protein, 107 aa, Artificial Sequence
  Description of Artificial Sequence: Synthetic polypeptide
  Incyte Camrelizumab VL
DIQMTQSPSSLSASVGDRVTITCLASQTIGTWLTWYQQKPGKAPKLLIYTATSLADGVPSRFSGSGSGTDFTLTISSLQPEDFATYYCQQVYSIPWTFGGGTKVEIK

SEQ ID NO: 30019 - protein, 118 aa, Artificial Sequence
  Description of Artificial Sequence: Synthetic polypeptide
  Beigene 317-4B6 VH
QVQLQESGPGLVKPSETLSLTCTVSGFSLTSYGVHWIRQPPGKGLEWIGVIYADGSTNYNPSLKSRVTISKDTSKNQVSLKLSSVTAADTAVYYCARAYGNYWYIDVWGQGTTVTVSS

SEQ ID NO: 30020 - protein, 107 aa, Artificial Sequence
  Description of Artificial Sequence: Synthetic polypeptide
  Beigene 317-4B6 VL
DIVMTQSPDSLAVSLGERATINCKSSESVSNDVAWYQQKPGQPPKLLINYAFHRFTGVPDRFSGSGYGTDFTLTISSLQAEDVAVYYCHQAYSSPYTFGQGTKLEIK

SEQ ID NO: 30021 - protein, 114 aa, Artificial Sequence
  Description of Artificial Sequence: Synthetic polypeptide
  Beigene 326-4A3 VH
QVQLVQSGSELKKPGASVKVSCKASGYTFTNYGMNWVRQAPGQGLKWMGWINNNNAEPTYAQDFRGRFVFSLDTSASTAYLQISSLKTEDTAVYYCARDVMDYWGQGTLVTVSS

SEQ ID NO: 30022 - protein, 110 aa, Artificial Sequence
  Description of Artificial Sequence: Synthetic polypeptide
  Beigene 326-4A3 VL
DIVLTQSPASLAVSPGQRATITCRASESVDNYGYSFMHWYQQKPGQPPKLLIYRASNLESGVPARFSGSGSGTDFTLTINPVEAEDTANYYCQQSKEYPTFGGGTKVEIK

SEQ ID NO: 30023 - protein, 119 aa, Artificial Sequence; identical to SEQ ID NO: 27009
  Description of Artificial Sequence: Synthetic polypeptide
  Macrogenics mAb 7 (1.2) VH

SEQ ID NO: 30024 - protein, 111 aa, Artificial Sequence; identical to SEQ ID NO: 27008
  Description of Artificial Sequence: Synthetic polypeptide
  Macrogenics mAb 7 (1.2) VL

SEQ ID NO: 30025 - protein, 125 aa, Artificial Sequence [sequence omitted]

SEQ ID NO: 30026 - protein, 112 aa, Artificial Sequence [sequence omitted]

SEQ ID NO: 30027 - protein, 125 aa, Artificial Sequence
  Description of Artificial Sequence: Synthetic polypeptide
  Junmeng Clone 39 VH
QGQLVQSGAEVKKPGASVKVSCKASGYTFTDYEMHWVRQAPGQGLEWMGVIESETGGTAYNQKFKGRAKITADKSTSTAYMELSSLRSEDTAVYYCTREGITTVATTYYWYFDVWGQGTTVTVSS

SEQ ID NO: 30028 - protein, 112 aa, Artificial Sequence [sequence omitted]

SEQ ID NO: 30029 - protein, 125 aa, Artificial Sequence
  Description of Artificial Sequence: Synthetic polypeptide
  Junmeng Clone 41 VH
QGQLVQSGAEVKKPGASVKVSCKASGYTFTDYEMHWVRQAPGQGLEWMGVIESETGGTAYNQKFQGRVTLTADKSSSTAYMELSSLRSEDTAVYYCTREGITTVATTYYWYFDVWGQGTLVTVSS

SEQ ID NO: 30030 - protein, 112 aa, Artificial Sequence [sequence omitted]

SEQ ID NO: 30031 - protein, 125 aa, Artificial Sequence; identical to SEQ ID NO: 30027
  Description of Artificial Sequence: Synthetic polypeptide
  Junmeng Clone 48 VH

SEQ ID NO: 30032 - protein, 112 aa, Artificial Sequence
  Description of Artificial Sequence: Synthetic polypeptide
  Junmeng Clone 48 VL
DVVMTQSPLSLPVTLGQPASISCRSSQSIVHSNGNTYLEWYLQKPGQSPRLLIYKVSNRFSGVPDRFSGSGSGTDFTLKISRVEAEDVGVYYCFQGSHVPLTFGQGTKLEIK

SEQ ID NO: 30033 - protein, 128 aa, Artificial Sequence
  Description of Artificial Sequence: Synthetic polypeptide
  Wyeth PD1-17 VH
QVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSS

SEQ ID NO: 30034 - protein, 110 aa, Artificial Sequence
  Description of Artificial Sequence: Synthetic polypeptide
  Wyeth PD1-17 VL
NFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVL

SEQ ID NO: 30035 - protein, 119 aa, Artificial Sequence
  Description of Artificial Sequence: Synthetic polypeptide
  Wyeth PD1-28 VH
EVQLVQSGAEVKKPGASVKVSCKASGYRFTSYGISWVRQAPGQGLEWMGWISAYNGNTNYAQKLQGRVTMTTDTSTNTAYMELRSLRSDDTAVYYCARDADYSSGSGYWGQGTLVTVSS

SEQ ID NO: 30036 - protein, 108 aa, Artificial Sequence
  Description of Artificial Sequence: Synthetic polypeptide
  Wyeth PD1-28 VL
SYELTQPPSVSVSPGQTARITCSGDALPKQYAYWYQQKPGQAPVMVIYKDTERPSGIPERFSGSSSGTKVTLTISGVQAEDEADYYCQSADNSITYRVFGGGTKVTVL

SEQ ID NO: 30037 - protein, 119 aa, Artificial Sequence
  Description of Artificial Sequence: Synthetic polypeptide
  Wyeth PD1-33 VH
QVQLVQSGAEVKKPGASVRVSCKASGYTLTSYYIHWVRQAPGQGLEWMGIINPRGATISYAQKFQGRVTMTRDTSTSTVYMELRNLKSEDTALYYCATAGIYGFDFDYWGRGTLVTVSS

SEQ ID NO: 30038 - protein, 111 aa, Artificial Sequence
  Description of Artificial Sequence: Synthetic polypeptide
  Wyeth PD1-33 VL
QSALTQPASVSGSPGQSITISCTGTSNDVGGYNYVSWYQHHPGKAPKLIIYDVTNRPSGVSDRFSGSKSGNTASLTISGLLAEDEGDYYCSSYTIVTNFEVLFGGGTKLTV

SEQ ID NO: 30039 - protein, 127 aa, Artificial Sequence
  Description of Artificial Sequence: Synthetic polypeptide
  Wyeth PD1-35 VH
QVQLQESGPGLVKPSQTLSLTCTVSGGSISSGAYYWSWIRQHPGKGLEWIGYIYYNGNTYYNPSLRSLVTISVDASKNQFSLKLSSVTAADTAVYYCARASDYVWGGYRYMDAFDIWGRGTLITVSS

SEQ ID NO: 30040 - protein, 110 aa, Artificial Sequence
  Description of Artificial Sequence: Synthetic polypeptide
  Wyeth PD1-35 VL
QSVLTQPPSASGTPGQRVTISCSGSNSNIGSNSVNWYQQLPGTAPKLLIYGNNQRPSGVPDRFSGSKSGTSASLAISGLQSENEADYYCAAWDDSLNGPVFGRGTKVTVL

SEQ ID NO: 30041 - protein, 127 aa, Artificial Sequence; identical to SEQ ID NO: 26823
  Description of Artificial Sequence: Synthetic polypeptide
  Wyeth LOPD180 VH

SEQ ID NO: 30042 - protein, 110 aa, Artificial Sequence; identical to SEQ ID NO: 26838
  Description of Artificial Sequence: Synthetic polypeptide
  Wyeth LOPD180 VL

SEQ ID NO: 30043 - protein, 120 aa, Artificial Sequence
  Description of Artificial Sequence: Synthetic polypeptide
  UCB Ab948 VH
EVQLQESGPGLVKPSQTLSLTCTVTGYSITSDYAWNWIRQPPGKKLEWMGYINYSGSTSYNPSLKSRVTISRDTSKNQFSLKLSSVTAADTAVYYCARWIGSSAWYFDVWGQGTLVTVSS

SEQ ID NO: 30044 - protein, 112 aa, Artificial Sequence
  Description of Artificial Sequence: Synthetic polypeptide
  UCB Ab948 VL
DVLMTQTPLSLSVTPGQPASISCRSGQNIVHSNGNTYLEWYLQKPGQSPKLLIYKVSNRFFGVPDRISGSGSGTDFTLKISRVEAEDVGVYFCFQGSHVPFTFGQGTKLEIK

SEQ ID NO: 30045 - protein, 121 aa, Artificial Sequence
  Description of Artificial Sequence: Synthetic polypeptide
  Dana-Farber EH-12.2h7 VH
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 30046 - protein, 111 aa, Artificial Sequence
  Description of Artificial Sequence: Synthetic polypeptide
  Dana-Farber EH-12.2h7 VH
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 30047 - protein, 119 aa, Artificial Sequence
  Description of Artificial Sequence: Synthetic polypeptide
  Sorrento RG1H10 VH
QVQLVQSGSELKKPGASVKISCKASGYIFSDNGVNWVRQAPGQGLEWMGWINTKIGNPTYAQGFTGRFVFSLDTSISTTYLQISSLQAGDTAVYYCAREHDYYYGMDVWGQGTTVTVSS

SEQ ID NO: 30048 - protein, 111 aa, Artificial Sequence
  Description of Artificial Sequence: Synthetic polypeptide
  Sorrento RG1H10 VL
QSALTQPPSASGSPGQSVTISCTGTSSDVGGYNYVSWYQHHPGKAPKLMIYEVSKRPSGVPDRFSGSKSAITASLTISGLLTEDEADYYCSAWDDSLNADVFGGGTKVTVL

SEQ ID NO: 30049 - protein, 119 aa, Artificial Sequence
  Description of Artificial Sequence: Synthetic polypeptide
  Sorrento RG1H10-H2A-22-1S VH
QVQLVQSGSELKKPGASVKISCKASGYIFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 30050 - protein, 111 aa, Artificial Sequence; identical to SEQ ID NO: 30048
  Description of Artificial Sequence: Synthetic polypeptide
  Sorrento RG1H10-H2A-22-1S VL

SEQ ID NO: 30051 - protein, 119 aa, Artificial Sequence
  Description of Artificial Sequence: Synthetic polypeptide
  Sorrento RG1H10-H2A-27-2S VH
QVQLVQSGSELKKPGASVKISCKASGYIFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 30052 - protein, 111 aa, Artificial Sequence; identical to SEQ ID NO: 30048
  Description of Artificial Sequence: Synthetic polypeptide
  Sorrento RG1H10-H2A-27-2S VL

SEQ ID NO: 30053 - protein, 119 aa, Artificial Sequence
  Description of Artificial Sequence: Synthetic polypeptide
  Sorrento RG1H10-3C VH
QVQLVQSGSELKKPGASVKISCKASGYTFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 30054 - protein, 111 aa, Artificial Sequence; identical to SEQ ID NO: 30048
  Description of Artificial Sequence: Synthetic polypeptide
  Sorrento RG1H10-3C VL

SEQ ID NO: 30055 - protein, 118 aa, Artificial Sequence
  Description of Artificial Sequence: Synthetic polypeptide
  Sorrento RG1H10-16C VH
QVQLVQSGSELKKPGASVKISCKASGYTFSDNGVNWVRQAPGQGLEWMGWINTKTGNPTYAQGFTGRFVFSLDTSISTTYLQISSLQAGDTAVYYCAREHDYYYGMDVWGQGTTVTVS

SEQ ID NO: 30056 - protein, 111 aa, Artificial Sequence; identical to SEQ ID NO: 30048
  Description of Artificial Sequence: Synthetic polypeptide
  Sorrento RG1H10-16C VL

SEQ ID NO: 30057 - protein, 119 aa, Artificial Sequence
  Description of Artificial Sequence: Synthetic polypeptide
  Sorrento RG1H10-17C VH
QVQLVQSGSELKKPGASVKISCKASGYKFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 30058 - protein, 111 aa, Artificial Sequence; identical to SEQ ID NO: 30048
  Description of Artificial Sequence: Synthetic polypeptide
  Sorrento RG1H10-17C VL

SEQ ID NO: 30059 - protein, 119 aa, Artificial Sequence
  Description of Artificial Sequence: Synthetic polypeptide
  Sorrento RG1H10-19C VH
QVQLVQSGSELKKPGASVKISCKASGYKFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 30060 - protein, 111 aa, Artificial Sequence; identical to SEQ ID NO: 30048
  Description of Artificial Sequence: Synthetic polypeptide
  Sorrento RG1H10-19C VL

SEQ ID NO: 30061 - protein, 119 aa, Artificial Sequence
  Description of Artificial Sequence: Synthetic polypeptide
  Sorrento RG1H10-21C VH
QVQLVQSGSELKKPGASVKISCKASGYTFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 30062 - protein, 111 aa, Artificial Sequence; identical to SEQ ID NO: 30048
  Description of Artificial Sequence: Synthetic polypeptide
  Sorrento RG1H10-21C VL

SEQ ID NO: 30063 - protein, 119 aa, Artificial Sequence
  Description of Artificial Sequence: Synthetic polypeptide
  Sorrento RG1H10-23C2 VH
QVQLVQSGSELKKPGASVKISCKASGYKFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 30064 - protein, 111 aa, Artificial Sequence; identical to SEQ ID NO: 30048
  Description of Artificial Sequence: Synthetic polypeptide
  Sorrento RG1H10-23C2 VL

SEQ ID NO: 30065 - protein, 117 aa, Artificial Sequence
  Description of Artificial Sequence: Synthetic polypeptide
  Rinat mAb 7 VH
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSS

SEQ ID NO: 30066 - protein, 113 aa, Artificial Sequence
  Description of Artificial Sequence: Synthetic polypeptide
  Rinat mAb 7 VL
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPHTFGGGTKVEIK

SEQ ID NO: 30067 - protein, 124 aa, Artificial Sequence
  Description of Artificial Sequence: Synthetic polypeptide
  Celgene PD1AB-6 VH
EVQLVQSGAEVKKPGATVKISCKASGFNIKDTYMHWVQQAPGKGLEWMGRIDPANGDRKYDPKFQGRVTITADTSTDTAYMELSSLRSEDTAVYYCARSGPVYYYGSSYVMDYWGQGTTVTVSS

SEQ ID NO: 30068 - protein, 112 aa, Artificial Sequence
  Description of Artificial Sequence: Synthetic polypeptide
  Celgene PD1AB-6 VL
DIVMTQSPDSLAVSLGERATINCKSGQSVLYSSNQKNFLAWYQQKPGQPPKLLIYWASTRESGVPDRFSGSGSGTDFTLTISSLQAEDVAVYYCHQYLYSWTFGQGTKLEIK

SEQ ID NO: 30069 - protein, 124 aa, Artificial Sequence; identical to SEQ ID NO: 26313
  Description of Artificial Sequence: Synthetic polypeptide
  GSK 88.2 VH

SEQ ID NO: 30070 - protein, 112 aa, Artificial Sequence; identical to SEQ ID NO: 26318
  Description of Artificial Sequence: Synthetic polypeptide
  GSK 88.2 VL

SEQ ID NO: 30071 - protein, 123 aa, Artificial Sequence; identical to SEQ ID NO: 26303
  Description of Artificial Sequence: Synthetic polypeptide
  GSK 314.8 VH

SEQ ID NO: 30072 - protein, 112 aa, Artificial Sequence; identical to SEQ ID NO: 26308
  Description of Artificial Sequence: Synthetic polypeptide
  GSK 314.8 VL

SEQ ID NO: 30073 - protein, 121 aa, Artificial Sequence; identical to SEQ ID NO: 26343
  Description of Artificial Sequence: Synthetic polypeptide
  GSK H2L5 VH

SEQ ID NO: 30074 - protein, 106 aa, Artificial Sequence; identical to SEQ ID NO: 26348
  Description of Artificial Sequence: Synthetic polypeptide
  GSK H2L5 VL

SEQ ID NO: 30075 - protein, 117 aa, Artificial Sequence; identical to SEQ ID NO: 26353
  Description of Artificial Sequence: Synthetic polypeptide
  Jounce 37A10S713 VH

SEQ ID NO: 30076 - protein, 111 aa, Artificial Sequence; identical to SEQ ID NO: 26358
  Description of Artificial Sequence: Synthetic polypeptide
  Jounce 37A10S713 VL

SEQ ID NO: 30077 - protein, 125 aa, Artificial Sequence; identical to SEQ ID NO: 26293
  Description of Artificial Sequence: Synthetic polypeptide
  Japan Tobacco Jmab-136 VH

SEQ ID NO: 30078 - protein, 107 aa, Artificial Sequence; identical to SEQ ID NO: 26298
  Description of Artificial Sequence: Synthetic polypeptide
  Japan Tobacco Jmab-136 VL

SEQ ID NO: 30079 - protein, 125 aa, Artificial Sequence; identical to SEQ ID NO: 26323
  Description of Artificial Sequence: Synthetic polypeptide
  Japan Tobacco Jmab-138 VH

SEQ ID NO: 30080 - protein, 109 aa, Artificial Sequence; identical to SEQ ID NO: 26328
  Description of Artificial Sequence: Synthetic polypeptide
  Japan Tobacco Jmab-138 VL

SEQ ID NO: 30081 - protein, 125 aa, Artificial Sequence; identical to SEQ ID NO: 26333
  Description of Artificial Sequence: Synthetic polypeptide
  Japan Tobacco Jmab-139 VH

SEQ ID NO: 30082 - protein, 109 aa, Artificial Sequence; identical to SEQ ID NO: 26338
  Description of Artificial Sequence: Synthetic polypeptide
  Japan Tobacco Jmab-139 VL

SEQ ID NO: 30083 - protein, 121 aa, Artificial Sequence; identical to SEQ ID NO: 3961
  Description of Artificial Sequence: Synthetic polypeptide
  AstraZeneca/Celgene/MedImmune 2.14H9 OPT VH

SEQ ID NO: 30084 - protein, 108 aa, Artificial Sequence; identical to SEQ ID NO: 3965
  Description of Artificial Sequence: Synthetic polypeptide
  AstraZeneca/Celgene/MedImmune 2.14H9 OPT VL

SEQ ID NO: 30085 - protein, 118 aa, Artificial Sequence; identical to SEQ ID NO: 3969
  Description of Artificial Sequence: Synthetic polypeptide
  Genentech atezolizumab VH

SEQ ID NO: 30086 - protein, 108 aa, Artificial Sequence; identical to SEQ ID NO: 3973
  Description of Artificial Sequence: Synthetic polypeptide
  Genentech atezolizumab VL

SEQ ID NO: 30087 - protein, 120 aa, Artificial Sequence; identical to SEQ ID NO: 3977
  Description of Artificial Sequence: Synthetic polypeptide
  Merck/Pfizer avelumab VH

SEQ ID NO: 30088 - protein, 110 aa, Artificial Sequence; identical to SEQ ID NO: 3981
  Description of Artificial Sequence: Synthetic polypeptide
  Merck/Pfizer avelumab VL

SEQ ID NO: 30089 - protein, 123 aa, Artificial Sequence; identical to SEQ ID NO: 3985
  Description of Artificial Sequence: Synthetic polypeptide
  Medarex 12A4 VH

SEQ ID NO: 30090 - protein, 106 aa, Artificial Sequence; identical to SEQ ID NO: 3989
  Description of Artificial Sequence: Synthetic polypeptide
  Medarex 12A4 VL

SEQ ID NO: 30091 - protein, 117 aa, Artificial Sequence; identical to SEQ ID NO: 3993
  Description of Artificial Sequence: Synthetic polypeptide
  Medarex 3G10 VH

SEQ ID NO: 30092 - protein, 107 aa, Artificial Sequence; identical to SEQ ID NO: 3997
  Description of Artificial Sequence: Synthetic polypeptide
  Medarex 3G10 VL

SEQ ID NO: 30093 - protein, 118 aa, Artificial Sequence; identical to SEQ ID NO: 4001
  Description of Artificial Sequence: Synthetic polypeptide
  Medarex 10A5 VH

SEQ ID NO: 30094 - protein, 107 aa, Artificial Sequence; identical to SEQ ID NO: 4005
  Description of Artificial Sequence: Synthetic polypeptide
  Medarex 10A5 VL

SEQ ID NO: 30095 - protein, 114 aa, Artificial Sequence; identical to SEQ ID NO: 4009
  Description of Artificial Sequence: Synthetic polypeptide
  Amplimmune/GSK/MedImmune h3D10 Var1 VH

SEQ ID NO: 30096 - protein, 106 aa, Artificial Sequence; identical to SEQ ID NO: 4013
  Description of Artificial Sequence: Synthetic polypeptide
  Amplimmune/GSK/MedImmune h3D10 Var1 VL

SEQ ID NO: 30097 - protein, 114 aa, Artificial Sequence; identical to SEQ ID NO: 4017
  Description of Artificial Sequence: Synthetic polypeptide
  Amplimmune/GSK/MedImmune h3D10 Var2 VH

SEQ ID NO: 30098 - protein, 106 aa, Artificial Sequence; identical to SEQ ID NO: 4021
  Description of Artificial Sequence: Synthetic polypeptide
  Amplimmune/GSK/MedImmune h3D10 Var2 VL

SEQ ID NO: 30099 - protein, 114 aa, Artificial Sequence; identical to SEQ ID NO: 4017
  Description of Artificial Sequence: Synthetic polypeptide
  Amplimmune/GSK/MedImmune h3D10 Var3 VH

SEQ ID NO: 30100 - protein, 106 aa, Artificial Sequence; identical to SEQ ID NO: 4029
  Description of Artificial Sequence: Synthetic polypeptide
  Amplimmune/GSK/MedImmune h3D10 Var3 VL

SEQ ID NO: 30101 - protein, 114 aa, Artificial Sequence; identical to SEQ ID NO: 4033
  Description of Artificial Sequence: Synthetic polypeptide
  Amplimmune/GSK/MedImmune h3D10 Var4 VH

SEQ ID NO: 30102 - protein, 106 aa, Artificial Sequence; identical to SEQ ID NO: 4021
  Description of Artificial Sequence: Synthetic polypeptide
  Amplimmune/GSK/MedImmune h3D10 Var4 VL

SEQ ID NO: 30103 - protein, 114 aa, Artificial Sequence; identical to SEQ ID NO: 4073
  Description of Artificial Sequence: Synthetic polypeptide
  Amplimmune/GSK/MedImmune h3D10 Var5 VH

SEQ ID NO: 30104 - protein, 106 aa, Artificial Sequence; identical to SEQ ID NO: 4069
  Description of Artificial Sequence: Synthetic polypeptide
  Amplimmune/GSK/MedImmune h3D10 Var5 VL

SEQ ID NO: 30105 - protein, 114 aa, Artificial Sequence; identical to SEQ ID NO: 4049
  Description of Artificial Sequence: Synthetic polypeptide
  Amplimmune/GSK/MedImmune h3D10 Var6 VH

SEQ ID NO: 30106 - protein, 106 aa, Artificial Sequence; identical to SEQ ID NO: 4013
  Description of Artificial Sequence: Synthetic polypeptide
  Amplimmune/GSK/MedImmune h3D10 Var6 VL

SEQ ID NO: 30107 - protein, 114 aa, Artificial Sequence; identical to SEQ ID NO: 4009
  Description of Artificial Sequence: Synthetic polypeptide
  Amplimmune/GSK/MedImmune h3D10 Var7 VH

SEQ ID NO: 30108 - protein, 106 aa, Artificial Sequence; identical to SEQ ID NO: 4053
  Description of Artificial Sequence: Synthetic polypeptide
  Amplimmune/GSK/MedImmune h3D10 Var7 VL

SEQ ID NO: 30109 - protein, 114 aa, Artificial Sequence; identical to SEQ ID NO: 4073
  Description of Artificial Sequence: Synthetic polypeptide
  Amplimmune/GSK/MedImmune h3D10 Var8 VH

SEQ ID NO: 30110 - protein, 106 aa, Artificial Sequence; identical to SEQ ID NO: 4029
  Description of Artificial Sequence: Synthetic polypeptide
  Amplimmune/GSK/MedImmune h3D10 Var8 VL

SEQ ID NO: 30111 - protein, 114 aa, Artificial Sequence; identical to SEQ ID NO: 4073
  Description of Artificial Sequence: Synthetic polypeptide
  Amplimmune/GSK/MedImmune h3D10 Var9 VH

SEQ ID NO: 30112 - protein, 106 aa, Artificial Sequence; identical to SEQ ID NO: 4061
  Description of Artificial Sequence: Synthetic polypeptide
  Amplimmune/GSK/MedImmune h3D10 Var9 VL

SEQ ID NO: 30113 - protein, 114 aa, Artificial Sequence; identical to SEQ ID NO: 4073
  Description of Artificial Sequence: Synthetic polypeptide
  Amplimmune/GSK/MedImmune h3D10 Var10 VH

SEQ ID NO: 30114 - protein, 106 aa, Artificial Sequence; identical to SEQ ID NO: 4069
  Description of Artificial Sequence: Synthetic polypeptide
  Amplimmune/GSK/MedImmune h3D10 Var10 VL

SEQ ID NO: 30115 - protein, 114 aa, Artificial Sequence; identical to SEQ ID NO: 4049
  Description of Artificial Sequence: Synthetic polypeptide
  Amplimmune/GSK/MedImmune h3D10 Var11 VH

SEQ ID NO: 30116 - protein, 106 aa, Artificial Sequence; identical to SEQ ID NO: 4013
  Description of Artificial Sequence: Synthetic polypeptide
  Amplimmune/GSK/MedImmune h3D10 Var11 VL

SEQ ID NO: 30117 - protein, 114 aa, Artificial Sequence; identical to SEQ ID NO: 4009
  Description of Artificial Sequence: Synthetic polypeptide
  Amplimmune/GSK/MedImmune h3D10 Var12 VH

SEQ ID NO: 30118 - protein, 106 aa, Artificial Sequence; identical to SEQ ID NO: 4053
  Description of Artificial Sequence: Synthetic polypeptide
  Amplimmune/GSK/MedImmune h3D10 Var12 VL

SEQ ID NO: 30119 - protein, 114 aa, Artificial Sequence; identical to SEQ ID NO: 4073
  Description of Artificial Sequence: Synthetic polypeptide
  Amplimmune/GSK/MedImmune h3D10 Var13 VH

SEQ ID NO: 30120 - protein, 106 aa, Artificial Sequence; identical to SEQ ID NO: 4029
  Description of Artificial Sequence: Synthetic polypeptide
  Amplimmune/GSK/MedImmune h3D10 Var13 VL

SEQ ID NO: 30121 - protein, 114 aa, Artificial Sequence; identical to SEQ ID NO: 4033
  Description of Artificial Sequence: Synthetic polypeptide
  Amplimmune/GSK/MedImmune h3D10 Var14 VH

SEQ ID NO: 30122 - protein, 106 aa, Artificial Sequence; identical to SEQ ID NO: 4069
  Description of Artificial Sequence: Synthetic polypeptide
  Amplimmune/GSK/MedImmune h3D10 Var14 VL

SEQ ID NO: 30123 - protein, 123 aa, Artificial Sequence; identical to SEQ ID NO: 4121
  Description of Artificial Sequence: Synthetic polypeptide
  Eli Lily Antibody A VH

SEQ ID NO: 30124 - protein, 111 aa, Artificial Sequence; identical to SEQ ID NO: 4125
  Description of Artificial Sequence: Synthetic polypeptide
  Eli Lily Antibody A VL

SEQ ID NO: 30125 - protein, 116 aa, Artificial Sequence; identical to SEQ ID NO: 4129
  Description of Artificial Sequence: Synthetic polypeptide
  Cytomyx C5H9v2 VH

SEQ ID NO: 30126 - protein, 108 aa, Artificial Sequence
  Description of Artificial Sequence: Synthetic polypeptide
  Cytomyx C5H9v2 VL
DIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIKR

SEQ ID NO: 30127 - protein, 94 aa, Artificial Sequence
  Description of Artificial Sequence: Synthetic polypeptide
  Dana-Farber/Novartis Humanized 29E.2A3 VH
CKASGYTFTSYVMHWVKQAPGQRLEWIGYVNPFNDGTKYNEMFKGRATLTSDKSTSTAYMELSSLRSEDTAVYYCARQAWGYPWGQGTLVTVSS

SEQ ID NO: 30128 - protein, 111 aa, Artificial Sequence; identical to SEQ ID NO: 4141
  Description of Artificial Sequence: Synthetic polypeptide
  Dana-Farber/Novartis Humanized 29E.2A3 VL

SEQ ID NO: 30129 - protein, 121 aa, Artificial Sequence; identical to SEQ ID NO: 4145
  Description of Artificial Sequence: Synthetic polypeptide
  Dana-Farber/Novartis 1B9 VH

SEQ ID NO: 30130 - protein, 107 aa, Artificial Sequence; identical to SEQ ID NO: 4149
  Description of Artificial Sequence: Synthetic polypeptide
  Dana-Farber/Novartis 1B9 VL

SEQ ID NO: 30131 - protein, 121 aa, Artificial Sequence; identical to SEQ ID NO: 4153
  Description of Artificial Sequence: Synthetic polypeptide
  Dana-Farber/Novartis 4H1 VH

SEQ ID NO: 30132 - protein, 107 aa, Artificial Sequence; identical to SEQ ID NO: 4157
  Description of Artificial Sequence: Synthetic polypeptide
  Dana-Farber/Novartis 4H1 VL

SEQ ID NO: 30133 - protein, 120 aa, Artificial Sequence; identical to SEQ ID NO: 4161
  Description of Artificial Sequence: Synthetic polypeptide
  Dana-Farber/Novartis mAb-42 VH

SEQ ID NO: 30134 - protein, 112 aa, Artificial Sequence; identical to SEQ ID NO: 4165
  Description of Artificial Sequence: Synthetic polypeptide
  Dana-Farber/Novartis mAb-42 VL

SEQ ID NO: 30135 - protein, 120 aa, Artificial Sequence; identical to SEQ ID NO: 4169
  Description of Artificial Sequence: Synthetic polypeptide
  Dana-Farber/Novartis BAP058-03 VH

SEQ ID NO: 30136 - protein, 107 aa, Artificial Sequence; identical to SEQ ID NO: 4173
  Description of Artificial Sequence: Synthetic polypeptide
  Dana-Farber/Novartis BAP058-03 VL

SEQ ID NO: 30137 - protein, 120 aa, Artificial Sequence; identical to SEQ ID NO: 4177
  Description of Artificial Sequence: Synthetic polypeptide
  Dana-Farber/Novartis BAP058-04 VH

SEQ ID NO: 30138 - protein, 107 aa, Artificial Sequence; identical to SEQ ID NO: 4181
  Description of Artificial Sequence: Synthetic polypeptide
  Dana-Farber/Novartis BAP058-04 VL

SEQ ID NO: 30139 - protein, 120 aa, Artificial Sequence; identical to SEQ ID NO: 4185
  Description of Artificial Sequence: Synthetic polypeptide
  Dana-Farber/Novartis BAP058-06 VH

SEQ ID NO: 30140 - protein, 107 aa, Artificial Sequence; identical to SEQ ID NO: 4181
  Description of Artificial Sequence: Synthetic polypeptide
  Dana-Farber/Novartis BAP058-06 VL

SEQ ID NO: 30141 - protein, 120 aa, Artificial Sequence; identical to SEQ ID NO: 4193
  Description of Artificial Sequence: Synthetic polypeptide
  Dana-Farber/Novartis BAP058-07 VH

SEQ ID NO: 30142 - protein, 107 aa, Artificial Sequence; identical to SEQ ID NO: 4197
  Description of Artificial Sequence: Synthetic polypeptide
  Dana-Farber/Novartis BAP058-07 VL

SEQ ID NO: 30143 - protein, 120 aa, Artificial Sequence; identical to SEQ ID NO: 4169
  Description of Artificial Sequence: Synthetic polypeptide
  Dana-Farber/Novartis BAP058-11 VH

SEQ ID NO: 30144 - protein, 107 aa, Artificial Sequence; identical to SEQ ID NO: 4205
  Description of Artificial Sequence: Synthetic polypeptide
  Dana-Farber/Novartis BAP058-11 VL

SEQ ID NO: 30145 - protein, 120 aa, Artificial Sequence; identical to SEQ ID NO: 4209
  Description of Artificial Sequence: Synthetic polypeptide
  Dana-Farber/Novartis BAP058-13 VH

SEQ ID NO: 30146 - protein, 107 aa, Artificial Sequence; identical to SEQ ID NO: 4213
  Description of Artificial Sequence: Synthetic polypeptide
  Dana-Farber/Novartis BAP058-13 VL

SEQ ID NO: 30147 - protein, 121 aa, Artificial Sequence; identical to SEQ ID NO: 4217
  Description of Artificial Sequence: Synthetic polypeptide
  Sorrento H6 VH

SEQ ID NO: 30148 - protein, 108 aa, Artificial Sequence; identical to SEQ ID NO: 4221
  Description of Artificial Sequence: Synthetic polypeptide
  Sorrento H6 VL

SEQ ID NO: 30149 - protein, 121 aa, Artificial Sequence; identical to SEQ ID NO: 4225
  Description of Artificial Sequence: Synthetic polypeptide
  Sorrento RC5 VH

SEQ ID NO: 30150 - protein, 107 aa, Artificial Sequence; identical to SEQ ID NO: 4229
  Description of Artificial Sequence: Synthetic polypeptide
  Sorrento RC5 VL

SEQ ID NO: 30151 - protein, 123 aa, Artificial Sequence; identical to SEQ ID NO: 4233
  Description of Artificial Sequence: Synthetic polypeptide
  Sorrento SH1A1Q VH

SEQ ID NO: 30152 - protein, 110 aa, Artificial Sequence; identical to SEQ ID NO: 4237
  Description of Artificial Sequence: Synthetic polypeptide
  Sorrento SH1A1Q VL

SEQ ID NO: 30153 - protein, 118 aa, Artificial Sequence; identical to SEQ ID NO: 4241
  Description of Artificial Sequence: Synthetic polypeptide
  Sorrento SH1B3 VH

SEQ ID NO: 30154 - protein, 110 aa, Artificial Sequence; identical to SEQ ID NO: 4245
  Description of Artificial Sequence: Synthetic polypeptide
  Sorrento SH1B3 VL

SEQ ID NO: 30155 - protein, 118 aa, Artificial Sequence; identical to SEQ ID NO: 4249
  Description of Artificial Sequence: Synthetic polypeptide
  Sorrento SH1D1 VH

SEQ ID NO: 30156 - protein, 111 aa, Artificial Sequence; identical to SEQ ID NO: 4253
  Description of Artificial Sequence: Synthetic polypeptide
  Sorrento SH1D1 VL

SEQ ID NO: 30157 - protein, 118 aa, Artificial Sequence; identical to SEQ ID NO: 4241
  Description of Artificial Sequence: Synthetic polypeptide
  Sorrento SH1D2 VH

SEQ ID NO: 30158 - protein, 110 aa, Artificial Sequence; identical to SEQ ID NO: 4261
  Description of Artificial Sequence: Synthetic polypeptide
  Sorrento SH1D2 VL

SEQ ID NO: 30159 - protein, 118 aa, Artificial Sequence; identical to SEQ ID NO: 4249
  Description of Artificial Sequence: Synthetic polypeptide
  Sorrento SH1D12 VH

SEQ ID NO: 30160 - protein, 110 aa, Artificial Sequence; identical to SEQ ID NO: 4269
  Description of Artificial Sequence: Synthetic polypeptide
  Sorrento SH1D12 VL

SEQ ID NO: 30161 - protein, 118 aa, Artificial Sequence; identical to SEQ ID NO: 4249
  Description of Artificial Sequence: Synthetic polypeptide
  Sorrento SH1E1 VH

SEQ ID NO: 30162 - protein, 110 aa, Artificial Sequence; identical to SEQ ID NO: 4277
  Description of Artificial Sequence: Synthetic polypeptide
  Sorrento SH1E1 VL

SEQ ID NO: 30163 - protein, 118 aa, Artificial Sequence; identical to SEQ ID NO: 4241
  Description of Artificial Sequence: Synthetic polypeptide
  Sorrento SH1G9 VH

SEQ ID NO: 30164 - protein, 112 aa, Artificial Sequence; identical to SEQ ID NO: 4285
  Description of Artificial Sequence: Synthetic polypeptide
  Sorrento SH1G9 VL

SEQ ID NO: 30165 - protein, 120 aa, Artificial Sequence; identical to SEQ ID NO: 4289
  Description of Artificial Sequence: Synthetic polypeptide
  Sorrento SH1E6 VH

SEQ ID NO: 30166 - protein, 110 aa, Artificial Sequence; identical to SEQ ID NO: 4293
  Description of Artificial Sequence: Synthetic polypeptide
  Sorrento SH1E6 VL

SEQ ID NO: 30167 - protein, 118 aa, Artificial Sequence; identical to SEQ ID NO: 4297
  Description of Artificial Sequence: Synthetic polypeptide
  Sorrento SH1A2 VH

SEQ ID NO: 30168 - protein, 110 aa, Artificial Sequence; identical to SEQ ID NO: 4301
  Description of Artificial Sequence: Synthetic polypeptide
  Sorrento SH1A2 VL

SEQ ID NO: 30169 - protein, 118 aa, Artificial Sequence; identical to SEQ ID NO: 4305
  Description of Artificial Sequence: Synthetic polypeptide
  Sorrento SH1B1 VH

SEQ ID NO: 30170 - protein, 112 aa, Artificial Sequence; identical to SEQ ID NO: 4309
  Description of Artificial Sequence: Synthetic polypeptide
  Sorrento SH1B1 VL

SEQ ID NO: 30171 - protein, 121 aa, Artificial Sequence; identical to SEQ ID NO: 4313
  Description of Artificial Sequence: Synthetic polypeptide
  Sorrento H6B1L VH

SEQ ID NO: 30172 - protein, 108 aa, Artificial Sequence; identical to SEQ ID NO: 4317
  Description of Artificial Sequence: Synthetic polypeptide
  Sorrento H6B1L VL

SEQ ID NO: 30173 - protein, 121 aa, Artificial Sequence; identical to SEQ ID NO: 4321
  Description of Artificial Sequence: Synthetic polypeptide
  Sorrento H6A1 VH

SEQ ID NO: 30174 - protein, 108 aa, Artificial Sequence; identical to SEQ ID NO: 4221
  Description of Artificial Sequence: Synthetic polypeptide
  Sorrento H6A1 VL

SEQ ID NO: 30175 - protein, 121 aa, Artificial Sequence; identical to SEQ ID NO: 4313
  Description of Artificial Sequence: Synthetic polypeptide
  Sorrento H6B1 VH

SEQ ID NO: 30176 - protein, 108 aa, Artificial Sequence; identical to SEQ ID NO: 4221
  Description of Artificial Sequence: Synthetic polypeptide
  Sorrento H6B1 VL

SEQ ID NO: 30177 - protein, 121 aa, Artificial Sequence; identical to SEQ ID NO: 4337
  Description of Artificial Sequence: Synthetic polypeptide
  Sorrento H6B2 VH

SEQ ID NO: 30178 - protein, 108 aa, Artificial Sequence; identical to SEQ ID NO: 4221
  Description of Artificial Sequence: Synthetic polypeptide
  Sorrento H6B2 VL

SEQ ID NO: 30179 - protein, 118 aa, Artificial Sequence; identical to SEQ ID NO: 4345
  Description of Artificial Sequence: Synthetic polypeptide
  Sorrento G12 VH

SEQ ID NO: 30180 - protein, 107 aa, Artificial Sequence; identical to SEQ ID NO: 4349
  Description of Artificial Sequence: Synthetic polypeptide
  Sorrento G12 VL

SEQ ID NO: 30181 - protein, 118 aa, Artificial Sequence; identical to SEQ ID NO: 4353
  Description of Artificial Sequence: Synthetic polypeptide
  Sorrento RSA1 VH

SEQ ID NO: 30182 - protein, 108 aa, Artificial Sequence; identical to SEQ ID NO: 4357
  Description of Artificial Sequence: Synthetic polypeptide
  Sorrento RSA1 VL

SEQ ID NO: 30183 - protein, 120 aa, Artificial Sequence; identical to SEQ ID NO: 4361
  Description of Artificial Sequence: Synthetic polypeptide
  Sorrento RA3 VH

SEQ ID NO: 30184 - protein, 107 aa, Artificial Sequence; identical to SEQ ID NO: 4365
  Description of Artificial Sequence: Synthetic polypeptide
  Sorrento RA3 VL

SEQ ID NO: 30185 - protein, 119 aa, Artificial Sequence; identical to SEQ ID NO: 4369
  Description of Artificial Sequence: Synthetic polypeptide
  Sorrento SH1E2 VH

SEQ ID NO: 30186 - protein, 109 aa, Artificial Sequence; identical to SEQ ID NO: 4373
  Description of Artificial Sequence: Synthetic polypeptide
  Sorrento SH1E2 VL

SEQ ID NO: 30187 - protein, 120 aa, Artificial Sequence; identical to SEQ ID NO: 4289
  Description of Artificial Sequence: Synthetic polypeptide
  Sorrento SH1E4 VH

SEQ ID NO: 30188 - protein, 112 aa, Artificial Sequence; identical to SEQ ID NO: 4381
  Description of Artificial Sequence: Synthetic polypeptide
  Sorrento SH1E4 VL

SEQ ID NO: 30189 - protein, 121 aa, Artificial Sequence; identical to SEQ ID NO: 4385
  Description of Artificial Sequence: Synthetic polypeptide
  Sorrento SH1B11 VH

SEQ ID NO: 30190 - protein, 107 aa, Artificial Sequence; identical to SEQ ID NO: 4389
  Description of Artificial Sequence: Synthetic polypeptide
  Sorrento SH1B11 VL

SEQ ID NO: 30191 - protein, 119 aa, Artificial Sequence; identical to SEQ ID NO: 4393
  Description of Artificial Sequence: Synthetic polypeptide
  Sorrento SH1C8 VH

SEQ ID NO: 30192 - protein, 111 aa, Artificial Sequence; identical to SEQ ID NO: 4397
  Description of Artificial Sequence: Synthetic polypeptide
  Sorrento SH1C8 VL

SEQ ID NO: 30193 - protein, 123 aa, Artificial Sequence; identical to SEQ ID NO: 4401
  Description of Artificial Sequence: Synthetic polypeptide
  Regeneron H1H9364P2 VH

SEQ ID NO: 30194 - protein, 108 aa, Artificial Sequence; identical to SEQ ID NO: 4405
  Description of Artificial Sequence: Synthetic polypeptide
  Regeneron H1H9364P2 VL

SEQ ID NO: 30195 - protein, 120 aa, Artificial Sequence; identical to SEQ ID NO: 4409
  Description of Artificial Sequence: Synthetic polypeptide
  Regeneron H1H9373P2 VH

SEQ ID NO: 30196 - protein, 108 aa, Artificial Sequence; identical to SEQ ID NO: 4405
  Description of Artificial Sequence: Synthetic polypeptide
  Regeneron H1H9373P2 VL

SEQ ID NO: 30197 - protein, 120 aa, Artificial Sequence; identical to SEQ ID NO: 4417
  Description of Artificial Sequence: Synthetic polypeptide
  Regeneron H1H8314N VH

SEQ ID NO: 30198 - protein, 108 aa, Artificial Sequence; identical to SEQ ID NO: 4421
  Description of Artificial Sequence: Synthetic polypeptide
  Regeneron H1H8314N VL

SEQ ID NO: 30199 - protein, 119 aa, Artificial Sequence; identical to SEQ ID NO: 4425
  Description of Artificial Sequence: Synthetic polypeptide
  Inserm PDL1.3.1 VH

SEQ ID NO: 30200 - protein, 106 aa, Artificial Sequence; identical to SEQ ID NO: 4429
  Description of Artificial Sequence: Synthetic polypeptide
  Inserm PDL1.3.1 VL

SEQ ID NO: 30201 - protein, 118 aa, Artificial Sequence; identical to SEQ ID NO: 3737
  Description of Artificial Sequence: Synthetic polypeptide
  Medarex Ipilimumab VH

SEQ ID NO: 30202 - protein, 108 aa, Artificial Sequence; identical to SEQ ID NO: 3741
  Description of Artificial Sequence: Synthetic polypeptide
  Medarex Ipilimumab VL

SEQ ID NO: 30203 - protein, 125 aa, Artificial Sequence; identical to SEQ ID NO: 3745
  Description of Artificial Sequence: Synthetic polypeptide
  Amgen/MedImmune/Pfizer Tremelimumab VH

SEQ ID NO: 30204 - protein, 107 aa, Artificial Sequence; identical to SEQ ID NO: 3749
  Description of Artificial Sequence: Synthetic polypeptide
  Amgen/MedImmune/Pfizer Tremelimumab VL

SEQ ID NO: 30205 - protein, 118 aa, Artificial Sequence; identical to SEQ ID NO: 3753
  Description of Artificial Sequence: Synthetic polypeptide
  Agenus AGEN1884 VH

SEQ ID NO: 30206 - protein, 107 aa, Artificial Sequence; identical to SEQ ID NO: 3757
  Description of Artificial Sequence: Synthetic polypeptide
  Agenus AGEN1884 VL

SEQ ID NO: 30207 - protein, 116 aa, Artificial Sequence; identical to SEQ ID NO: 3761
  Description of Artificial Sequence: Synthetic polypeptide
  Tegenero 4.3F6B5 VH

SEQ ID NO: 30208 - protein, 107 aa, Artificial Sequence
  Description of Artificial Sequence: Synthetic polypeptide
  Tegenero 4.3F6B5 VL
DILMTQSPASLSASVGETVTITCGASENIYGALNWYQRKQGKSPQLLIYGATNLADGMSSRFSGSGLGRQYYLKISSLHPDDVATYFCQNILGTWTFGGGTKLEIKR

SEQ ID NO: 30209 - protein, 117 aa, Artificial Sequence; identical to SEQ ID NO: 3769
  Description of Artificial Sequence: Synthetic polypeptide
  Tegenero 4.8H10H5 VH

SEQ ID NO: 30210 - protein, 109 aa, Artificial Sequence
  Description of Artificial Sequence: Synthetic polypeptide
  Tegenero 4.8H10H5 VL
ENVLTQSPAIMSASPGERVTMTCSASSSVSYMHWYQQKSNTSPKLWIYDTSKLASGVPGRFSGSGSRNSYSLTISSMEAEDVATYYCFPGSGFPFMYTFGGGTKLEIKR

SEQ ID NO: 30211 - protein, 116 aa, Artificial Sequence; identical to SEQ ID NO: 3777
  Description of Artificial Sequence: Synthetic polypeptide
  Tegenero TGN2122.C VH

SEQ ID NO: 30212 - protein, 106 aa, Artificial Sequence; identical to SEQ ID NO: 3781
  Description of Artificial Sequence: Synthetic polypeptide
  Tegenero TGN2122.C VL

SEQ ID NO: 30213 - protein, 117 aa, Artificial Sequence; identical to SEQ ID NO: 3785
  Description of Artificial Sequence: Synthetic polypeptide
  Tegenero TGN2122.H VH

SEQ ID NO: 30214 - protein, 108 aa, Artificial Sequence; identical to SEQ ID NO: 3789
  Description of Artificial Sequence: Synthetic polypeptide
  Tegenero TGN2122.H VL

SEQ ID NO: 30215 - protein, 123 aa, Artificial Sequence; identical to SEQ ID NO: 3793
  Description of Artificial Sequence: Synthetic polypeptide
  Sorrento F7 VH

SEQ ID NO: 30216 - protein, 107 aa, Artificial Sequence; identical to SEQ ID NO: 3797
  Description of Artificial Sequence: Synthetic polypeptide
  Sorrento F7 VL

SEQ ID NO: 30217 - protein, 121 aa, Artificial Sequence; identical to SEQ ID NO: 3801
  Description of Artificial Sequence: Synthetic polypeptide
  Sorrento E8 VH

SEQ ID NO: 30218 - protein, 107 aa, Artificial Sequence; identical to SEQ ID NO: 3805
  Description of Artificial Sequence: Synthetic polypeptide
  Sorrento E8 VL

SEQ ID NO: 30219 - protein, 114 aa, Artificial Sequence; identical to SEQ ID NO: 3809
  Description of Artificial Sequence: Synthetic polypeptide
  Sorrento CT1E1 VH

SEQ ID NO: 30220 - protein, 108 aa, Artificial Sequence; identical to SEQ ID NO: 3813
  Description of Artificial Sequence: Synthetic polypeptide
  Sorrento CT1E1 VL

SEQ ID NO: 30221 - protein, 120 aa, Artificial Sequence; identical to SEQ ID NO: 3817
  Description of Artificial Sequence: Synthetic polypeptide
  Medarex BMS-986016 VH

SEQ ID NO: 30222 - protein, 107 aa, Artificial Sequence; identical to SEQ ID NO: 3821
  Description of Artificial Sequence: Synthetic polypeptide
  Medarex BMS-986016 VL

SEQ ID NO: 30223 - protein, 116 aa, Artificial Sequence; identical to SEQ ID NO: 3825
  Description of Artificial Sequence: Synthetic polypeptide
  Immutep/INSERM/Novartis IMP731 VH

SEQ ID NO: 30224 - protein, 113 aa, Artificial Sequence; identical to SEQ ID NO: 3829
  Description of Artificial Sequence: Synthetic polypeptide
  Immutep/INSERM/Novartis IMP731 VH

SEQ ID NO: 30225 - protein, 123 aa, Artificial Sequence; identical to SEQ ID NO: 3833
  Description of Artificial Sequence: Synthetic polypeptide
  Immutep/INSERM/Novartis 13E2 VH

SEQ ID NO: 30226 - protein, 107 aa, Artificial Sequence; identical to SEQ ID NO: 3837
  Description of Artificial Sequence: Synthetic polypeptide
  Immutep/INSERM/Novartis 13E2 VH

SEQ ID NO: 30227 - protein, 123 aa, Artificial Sequence; identical to SEQ ID NO: 3841
  Description of Artificial Sequence: Synthetic polypeptide
  Immutep/INSERM/Novartis 34F4 VH

SEQ ID NO: 30228 - protein, 107 aa, Artificial Sequence; identical to SEQ ID NO: 3845
  Description of Artificial Sequence: Synthetic polypeptide
  Immutep/INSERM/Novartis 34F4 VH

SEQ ID NO: 30229 - protein, 123 aa, Artificial Sequence; identical to SEQ ID NO: 3849
  Description of Artificial Sequence: Synthetic polypeptide
  Immutep/INSERM/Novartis IMP761 VH

SEQ ID NO: 30230 - protein, 107 aa, Artificial Sequence; identical to SEQ ID NO: 3853
  Description of Artificial Sequence: Synthetic polypeptide
  Immutep/INSERM/Novartis IMP761 VH

SEQ ID NO: 30231 - protein, 116 aa, Artificial Sequence; identical to SEQ ID NO: 3857
  Description of Artificial Sequence: Synthetic polypeptide
  GSK H5L7 VH

SEQ ID NO: 30232 - protein, 114 aa, Artificial Sequence
  Description of Artificial Sequence: Synthetic polypeptide
  GSK H5L7 VL
DIQMTQSPSSLSASVGDRVTITCKSSQSLLNPSNQKNYLAWYQQKPGKAPKLLVYFASTRDSGVPSRFSGSGSGTDFTLTISSLQPEDFATYYCLQHFGTPPTFGQGTKLEIKR

SEQ ID NO: 30233 - protein, 119 aa, Artificial Sequence; identical to SEQ ID NO: 3865
  Description of Artificial Sequence: Synthetic polypeptide
  Merck hu22D2 VH

SEQ ID NO: 30234 - protein, 111 aa, Artificial Sequence; identical to SEQ ID NO: 3869
  Description of Artificial Sequence: Synthetic polypeptide
  Merck hu22D2 VL

SEQ ID NO: 30235 - protein, 123 aa, Artificial Sequence; identical to SEQ ID NO: 3873
  Description of Artificial Sequence: Synthetic polypeptide
  Regeneron H4sH15482P VH

SEQ ID NO: 30236 - protein, 107 aa, Artificial Sequence; identical to SEQ ID NO: 3877
  Description of Artificial Sequence: Synthetic polypeptide
  Regeneron H4sH15482P VH

SEQ ID NO: 30237 - protein, 119 aa, Artificial Sequence; identical to SEQ ID NO: 3881
  Description of Artificial Sequence: Synthetic polypeptide
  Sorrento L35D4 VH

SEQ ID NO: 30238 - protein, 112 aa, Artificial Sequence; identical to SEQ ID NO: 3885
  Description of Artificial Sequence: Synthetic polypeptide
  Sorrento L35D4 VL

SEQ ID NO: 30239 - protein, 119 aa, Artificial Sequence; identical to SEQ ID NO: 3881
  Description of Artificial Sequence: Synthetic polypeptide
  Sorrento L35G6 VH

SEQ ID NO: 30240 - protein, 110 aa, Artificial Sequence; identical to SEQ ID NO: 3893
  Description of Artificial Sequence: Synthetic polypeptide
  Sorrento L35G6 VL

SEQ ID NO: 30241 - protein, 119 aa, Artificial Sequence; identical to SEQ ID NO: 3881
  Description of Artificial Sequence: Synthetic polypeptide
  Sorrento L33H11 VH

SEQ ID NO: 30242 - protein, 110 aa, Artificial Sequence; identical to SEQ ID NO: 3901
  Description of Artificial Sequence: Synthetic polypeptide
  Sorrento L33H11 VL

SEQ ID NO: 30243 - protein, 119 aa, Artificial Sequence; identical to SEQ ID NO: 3881
  Description of Artificial Sequence: Synthetic polypeptide
  Sorrento L32A9 VH

SEQ ID NO: 30244 - protein, 110 aa, Artificial Sequence; identical to SEQ ID NO: 3909
  Description of Artificial Sequence: Synthetic polypeptide
  Sorrento L32A9 VL

SEQ ID NO: 30245 - protein, 119 aa, Artificial Sequence; identical to SEQ ID NO: 3881
  Description of Artificial Sequence: Synthetic polypeptide
  Sorrento L32D10 VH

SEQ ID NO: 30246 - protein, 110 aa, Artificial Sequence; identical to SEQ ID NO: 3917
  Description of Artificial Sequence: Synthetic polypeptide
  Sorrento L32D10 VL

SEQ ID NO: 30247 - protein, 119 aa, Artificial Sequence; identical to SEQ ID NO: 3881
  Description of Artificial Sequence: Synthetic polypeptide
  Sorrento L32A4 VH

SEQ ID NO: 30248 - protein, 110 aa, Artificial Sequence; identical to SEQ ID NO: 3925
  Description of Artificial Sequence: Synthetic polypeptide
  Sorrento L32A4 VL

SEQ ID NO: 30249 - protein, 119 aa, Artificial Sequence; identical to SEQ ID NO: 3929
  Description of Artificial Sequence: Synthetic polypeptide
  Sorrento L3A1 VH

SEQ ID NO: 30250 - protein, 110 aa, Artificial Sequence; identical to SEQ ID NO: 3933
  Description of Artificial Sequence: Synthetic polypeptide
  Sorrento L3A1 VL

SEQ ID NO: 30251 - protein, 121 aa, Artificial Sequence; identical to SEQ ID NO: 3937
  Description of Artificial Sequence: Synthetic polypeptide
  Sorrento L3A10 VH

SEQ ID NO: 30252 - protein, 108 aa, Artificial Sequence; identical to SEQ ID NO: 3941
  Description of Artificial Sequence: Synthetic polypeptide
  Sorrento L3A10 VL

SEQ ID NO: 30253 - protein, 121 aa, Artificial Sequence; identical to SEQ ID NO: 3945
  Description of Artificial Sequence: Synthetic polypeptide
  Sorrento L3C5 VH

SEQ ID NO: 30254 - protein, 110 aa, Artificial Sequence; identical to SEQ ID NO: 3949
  Description of Artificial Sequence: Synthetic polypeptide
  Sorrento L3C5 VL

SEQ ID NO: 30255 - protein, 119 aa, Artificial Sequence; identical to SEQ ID NO: 3929
  Description of Artificial Sequence: Synthetic polypeptide
  Sorrento L3E3 VH

SEQ ID NO: 30256 - protein, 110 aa, Artificial Sequence; identical to SEQ ID NO: 3957
  Description of Artificial Sequence: Synthetic polypeptide
  Sorrento L3E3 VL

SEQ ID NO: 30257 - protein, 114 aa, Artificial Sequence
  Description of Artificial Sequence: Synthetic polypeptide
  AnaptysBio/Tesaro APE5137 VH
EVQLLESGGGLVQPGGSLRLSCAAASGFTFSSYDMSWVRQAPGKGLDWVSTISGGGTYTYYQDSVKGRFTISRDNSKNTLYLQMNSLRAEDTAVYYCASMDYWGQGTTVTVSSA

SEQ ID NO: 30258 - protein, 108 aa, Artificial Sequence
  Description of Artificial Sequence: Synthetic polypeptide
  AnaptysBio/Tesaro APE5137 VL
DIQMTQSPSSLSASVGDRVTITCRASQSIRRYLNWYHQKPGKAPKLLIYGASTLQSGVPSRFSGSGSGTDFTLTISSLQPEDFAVYYCQQSHSAPLTFGGGTKVEIKR

SEQ ID NO: 30259 - protein, 120 aa, Artificial Sequence
  Description of Artificial Sequence: Synthetic polypeptide
  AnaptysBio/Tesaro APE5121 VH
EVQVLESGGGLVQPGGSLRLYCVASGFTFSGSYAMSWVRQAPGKGLEWVSAISGSGGSTYYADSVKGRFTISRDNSKNTLYLQMNSLRAEDTAVYYCAKKYYVGPADYWGQGTLVTVSSG

SEQ ID NO: 30260 - protein, 113 aa, Artificial Sequence; identical to SEQ ID NO: 4597
  Description of Artificial Sequence: Synthetic polypeptide
  AnaptysBio/Tesaro APE5121 VL

SEQ ID NO: 30261 - protein, 118 aa, Artificial Sequence; identical to SEQ ID NO: 4601
  Description of Artificial Sequence: Synthetic polypeptide
  Dana-Farber/Novartis ABTIM3-hum03 VH

SEQ ID NO: 30262 - protein, 111 aa, Artificial Sequence; identical to SEQ ID NO: 4605
  Description of Artificial Sequence: Synthetic polypeptide
  Dana-Farber/Novartis ABTIM3-hum03 VL

SEQ ID NO: 30263 - protein, 118 aa, Artificial Sequence; identical to SEQ ID NO: 4609
  Description of Artificial Sequence: Synthetic polypeptide
  Dana-Farber/Novartis ABTIM3-hum11 VH

SEQ ID NO: 30264 - protein, 111 aa, Artificial Sequence; identical to SEQ ID NO: 4613
  Description of Artificial Sequence: Synthetic polypeptide
  Dana-Farber/Novartis ABTIM3-hum11 VL

SEQ ID NO: 30265 - protein, 118 aa, Artificial Sequence; identical to SEQ ID NO: 4601
  Description of Artificial Sequence: Synthetic polypeptide
  Dana-Farber/Novartis ABTIM3-hum21 VH

SEQ ID NO: 30266 - protein, 111 aa, Artificial Sequence; identical to SEQ ID NO: 4605
  Description of Artificial Sequence: Synthetic polypeptide
  Dana-Farber/Novartis ABTIM3-hum21 VL

SEQ ID NO: 30267 - protein, 121 aa, Artificial Sequence; identical to SEQ ID NO: 4625
  Description of Artificial Sequence: Synthetic polypeptide
  KHK 4177 VH

SEQ ID NO: 30268 - protein, 109 aa, Artificial Sequence; identical to SEQ ID NO: 4629
  Description of Artificial Sequence: Synthetic polypeptide
  KHK 4177 VL

SEQ ID NO: 30269 - protein, 121 aa, Artificial Sequence; identical to SEQ ID NO: 4633
  Description of Artificial Sequence: Synthetic polypeptide
  KHK 4545 VH

SEQ ID NO: 30270 - protein, 107 aa, Artificial Sequence; identical to SEQ ID NO: 4637
  Description of Artificial Sequence: Synthetic polypeptide
  KHK 4545 VL

SEQ ID NO: 30271 - protein, 117 aa, Artificial Sequence; identical to SEQ ID NO: 4641
  Description of Artificial Sequence: Synthetic polypeptide
  KHK 8123 VH

SEQ ID NO: 30272 - protein, 107 aa, Artificial Sequence; identical to SEQ ID NO: 4645
  Description of Artificial Sequence: Synthetic polypeptide
  KHK 8123 VL

SEQ ID NO: 30273 - protein, 117 aa, Artificial Sequence; identical to SEQ ID NO: 4649
  Description of Artificial Sequence: Synthetic polypeptide
  Jounce mAb15 VH

SEQ ID NO: 30274 - protein, 113 aa, Artificial Sequence; identical to SEQ ID NO: 4653
  Description of Artificial Sequence: Synthetic polypeptide
  Jounce mAb15 VL

SEQ ID NO: 30275 - protein, 121 aa, Artificial Sequence; identical to SEQ ID NO: 4657
  Description of Artificial Sequence: Synthetic polypeptide
  Jounce mAb58 VH

SEQ ID NO: 30276 - protein, 107 aa, Artificial Sequence; identical to SEQ ID NO: 4661
  Description of Artificial Sequence: Synthetic polypeptide
  Jounce mAb58 VL

SEQ ID NO: 30277 - protein, 120 aa, Artificial Sequence; identical to SEQ ID NO: 4665
  Description of Artificial Sequence: Synthetic polypeptide
  Roche TIM3-0433 VH

SEQ ID NO: 30278 - protein, 106 aa, Artificial Sequence; identical to SEQ ID NO: 4669
  Description of Artificial Sequence: Synthetic polypeptide
  Roche TIM3-0433 VH

SEQ ID NO: 30279 - protein, 120 aa, Artificial Sequence; identical to SEQ ID NO: 4665
  Description of Artificial Sequence: Synthetic polypeptide
  Roche TIM3-0434 VH

SEQ ID NO: 30280 - protein, 106 aa, Artificial Sequence; identical to SEQ ID NO: 4677
  Description of Artificial Sequence: Synthetic polypeptide
  Roche TIM3-0434 VH

SEQ ID NO: 30281 - protein, 119 aa, Artificial Sequence; identical to SEQ ID NO: 4681
  Description of Artificial Sequence: Synthetic polypeptide
  Roche TIM3-0438 VH

SEQ ID NO: 30282 - protein, 107 aa, Artificial Sequence; identical to SEQ ID NO: 4685
  Description of Artificial Sequence: Synthetic polypeptide
  Roche TIM3-0438 VH

SEQ ID NO: 30283 - protein, 119 aa, Artificial Sequence; identical to SEQ ID NO: 4689
  Description of Artificial Sequence: Synthetic polypeptide
  Roche TIM3-0443 VH

SEQ ID NO: 30284 - protein, 107 aa, Artificial Sequence; identical to SEQ ID NO: 4685
  Description of Artificial Sequence: Synthetic polypeptide
  Roche TIM3-0443 VH

SEQ ID NO: 30285 - protein, 120 aa, Artificial Sequence; identical to SEQ ID NO: 3705
  Description of Artificial Sequence: Synthetic polypeptide
  Medarex 3C2 VH

SEQ ID NO: 30286 - protein, 107 aa, Artificial Sequence [sequence omitted]

SEQ ID NO: 30287 - protein, 127 aa, Artificial Sequence; identical to SEQ ID NO: 3713
  Description of Artificial Sequence: Synthetic polypeptide
  Medarex 11E2 VH

SEQ ID NO: 30288 - protein, 107 aa, Artificial Sequence; identical to SEQ ID NO: 3717
  Description of Artificial Sequence: Synthetic polypeptide
  Medarex 11E2 VL

SEQ ID NO: 30289 - protein, 119 aa, Artificial Sequence; identical to SEQ ID NO: 3721
  Description of Artificial Sequence: Synthetic polypeptide
  Medarex 4C7 VH

SEQ ID NO: 30290 - protein, 108 aa, Artificial Sequence; identical to SEQ ID NO: 3725
  Description of Artificial Sequence: Synthetic polypeptide
  Medarex 4C7 VL

SEQ ID NO: 30291 - protein, 121 aa, Artificial Sequence; identical to SEQ ID NO: 3729
  Description of Artificial Sequence: Synthetic polypeptide
  Medarex 8D5 VH

SEQ ID NO: 30292 - protein, 108 aa, Artificial Sequence; identical to SEQ ID NO: 3733
  Description of Artificial Sequence: Synthetic polypeptide
  Medarex 8D5 VL

SEQ ID NO: 30293 - protein, 119 aa, Artificial Sequence; identical to SEQ ID NO: 4433
  Description of Artificial Sequence: Synthetic polypeptide
  Genentech 10A7 VH

SEQ ID NO: 30294 - protein, 113 aa, Artificial Sequence; identical to SEQ ID NO: 4437
  Description of Artificial Sequence: Synthetic polypeptide
  Genentech 10A7 VL

SEQ ID NO: 30295 - protein, 119 aa, Artificial Sequence; identical to SEQ ID NO: 4441
  Description of Artificial Sequence: Synthetic polypeptide
  Genentech 1F4 VH

SEQ ID NO: 30296 - protein, 112 aa, Artificial Sequence; identical to SEQ ID NO: 4445
  Description of Artificial Sequence: Synthetic polypeptide
  Genentech 1F4 VL

SEQ ID NO: 30297 - protein, 126 aa, Artificial Sequence; identical to SEQ ID NO: 4449
  Description of Artificial Sequence: Synthetic polypeptide
  Genentech 4.1D3 VH

SEQ ID NO: 30298 - protein, 113 aa, Artificial Sequence; identical to SEQ ID NO: 4453
  Description of Artificial Sequence: Synthetic polypeptide
  Genentech 4.1D3 VL

SEQ ID NO: 30299 - protein, 126 aa, Artificial Sequence; identical to SEQ ID NO: 4457
  Description of Artificial Sequence: Synthetic polypeptide
  Genentech 4.1D3.Q1E VH

SEQ ID NO: 30300 - protein, 113 aa, Artificial Sequence; identical to SEQ ID NO: 4453
  Description of Artificial Sequence: Synthetic polypeptide
  Genentech 4.1D3.Q1E VL

SEQ ID NO: 30301 - protein, 119 aa, Artificial Sequence; identical to SEQ ID NO: 4513
  Description of Artificial Sequence: Synthetic polypeptide
  Merck MEB125.31C6.A1.205 VH4/VL1 VH

SEQ ID NO: 30302 - protein, 107 aa, Artificial Sequence; identical to SEQ ID NO: 4517
  Description of Artificial Sequence: Synthetic polypeptide
  Merck MEB125.31C6.A1.205 VH4/VL1 VL

SEQ ID NO: 30303 - protein, 119 aa, Artificial Sequence; identical to SEQ ID NO: 4521
  Description of Artificial Sequence: Synthetic polypeptide
  Merck MEB125.31C6.A1.205 VH5/VL4 VH

SEQ ID NO: 30304 - protein, 107 aa, Artificial Sequence; identical to SEQ ID NO: 4525
  Description of Artificial Sequence: Synthetic polypeptide
  Merck MEB125.31C6.A1.205 VH5/VL4 VL

SEQ ID NO: 30305 - protein, 119 aa, Artificial Sequence; identical to SEQ ID NO: 4521
  Description of Artificial Sequence: Synthetic polypeptide
  Merck MEB125.31C6.A1.205 VH5/VL3 VH

SEQ ID NO: 30306 - protein, 107 aa, Artificial Sequence; identical to SEQ ID NO: 4533
  Description of Artificial Sequence: Synthetic polypeptide
  Merck MEB125.31C6.A1.205 VH5/VL3 VL

SEQ ID NO: 30307 - protein, 121 aa, Artificial Sequence; identical to SEQ ID NO: 4465
  Description of Artificial Sequence: Synthetic polypeptide
  Merck Hu14D7 VH1

SEQ ID NO: 30308 - protein, 121 aa, Artificial Sequence; identical to SEQ ID NO: 4469
  Description of Artificial Sequence: Synthetic polypeptide
  Merck Hu14D7 VH2

SEQ ID NO: 30309 - protein, 121 aa, Artificial Sequence; identical to SEQ ID NO: 4473
  Description of Artificial Sequence: Synthetic polypeptide
  Merck Hu14D7 VH3

SEQ ID NO: 30310 - protein, 108 aa, Artificial Sequence; identical to SEQ ID NO: 4477
  Description of Artificial Sequence: Synthetic polypeptide
  Merck Hu14D7 VL1

SEQ ID NO: 30311 - protein, 108 aa, Artificial Sequence; identical to SEQ ID NO: 4481
  Description of Artificial Sequence: Synthetic polypeptide
  Merck Hu14D7 VL2

SEQ ID NO: 30312 - protein, 108 aa, Artificial Sequence; identical to SEQ ID NO: 4485
  Description of Artificial Sequence: Synthetic polypeptide
  Merck Hu14D7 VL3

SEQ ID NO: 30313 - protein, 119 aa, Artificial Sequence; identical to SEQ ID NO: 4489
  Description of Artificial Sequence: Synthetic polypeptide
  Merck Hu26B10 VH1

SEQ ID NO: 30314 - protein, 119 aa, Artificial Sequence; identical to SEQ ID NO: 4493
  Description of Artificial Sequence: Synthetic polypeptide
  Merck Hu26B10 VH2

SEQ ID NO: 30315 - protein, 119 aa, Artificial Sequence; identical to SEQ ID NO: 4497
  Description of Artificial Sequence: Synthetic polypeptide
  Merck Hu26B10 VH3

SEQ ID NO: 30316 - protein, 107 aa, Artificial Sequence; identical to SEQ ID NO: 4501
  Description of Artificial Sequence: Synthetic polypeptide
  Merck Hu26B10 VL1

SEQ ID NO: 30317 - protein, 107 aa, Artificial Sequence; identical to SEQ ID NO: 4505
  Description of Artificial Sequence: Synthetic polypeptide
  Merck Hu26B10 VL2

SEQ ID NO: 30318 - protein, 107 aa, Artificial Sequence; identical to SEQ ID NO: 4509
  Description of Artificial Sequence: Synthetic polypeptide
  Merck Hu26B10 VL3

SEQ ID NO: 30319 - protein, 118 aa, Artificial Sequence; identical to SEQ ID NO: 4537
  Description of Artificial Sequence: Synthetic polypeptide
  BMS 15A6 VH

SEQ ID NO: 30320 - protein, 107 aa, Artificial Sequence; identical to SEQ ID NO: 4541
  Description of Artificial Sequence: Synthetic polypeptide
  BMS 15A6 VL

SEQ ID NO: 30321 - protein, 130 aa, Artificial Sequence; identical to SEQ ID NO: 4545
  Description of Artificial Sequence: Synthetic polypeptide
  BMS 22G2 VH

SEQ ID NO: 30322 - protein, 109 aa, Artificial Sequence; identical to SEQ ID NO: 4549
  Description of Artificial Sequence: Synthetic polypeptide
  BMS 22G2 VL

SEQ ID NO: 30323 - protein, 126 aa, Artificial Sequence; identical to SEQ ID NO: 4553
  Description of Artificial Sequence: Synthetic polypeptide
  BMS 11G11 VH

SEQ ID NO: 30324 - protein, 106 aa, Artificial Sequence; identical to SEQ ID NO: 4557
  Description of Artificial Sequence: Synthetic polypeptide
  BMS 11G11 VL

SEQ ID NO: 30325 - protein, 128 aa, Artificial Sequence; identical to SEQ ID NO: 4561
  Description of Artificial Sequence: Synthetic polypeptide
  BMS 10D7 VH

SEQ ID NO: 30326 - protein, 107 aa, Artificial Sequence; identical to SEQ ID NO: 4565
  Description of Artificial Sequence: Synthetic polypeptide
  BMS 10D7 VL

SEQ ID NO: 30327 - protein, 116 aa, Artificial Sequence; identical to SEQ ID NO: 4569
  Description of Artificial Sequence: Synthetic polypeptide
  Oncomed 313R19 VH

SEQ ID NO: 30328 - protein, 111 aa, Artificial Sequence
  Description of Artificial Sequence: Synthetic polypeptide
  Oncomed 313R19 VL
DIQMTQSPSSLSASVGDRVTITCQASQNIYSDLAWYQQKPGKAPKLLIYRASTLASGVPSRFSGSGSGTDFTLTISSLQPEDFATYYCQQEHLVAWIYNVFGQGTKVEIKR

SEQ ID NO: 30329 - protein, 118 aa, Artificial Sequence; identical to SEQ ID NO: 4577
  Description of Artificial Sequence: Synthetic polypeptide
  Oncomed 313M32 VH

SEQ ID NO: 30330 - protein, 99 aa, Artificial Sequence; identical to SEQ ID NO: 4581
  Description of Artificial Sequence: Synthetic polypeptide
  Oncomed 313M32 VL

SEQ ID NO: 30331 - protein, 118 aa, Artificial Sequence; identical to SEQ ID NO: 25612
  Description of Artificial Sequence: Synthetic polypeptide
  VH of XENP20269

SEQ ID NO: 30332 - protein, 5 aa, Artificial Sequence
  Description of Artificial Sequence: Synthetic peptide
  XENP20269 vhCDR1
GYGVN

SEQ ID NO: 30333 - protein, 16 aa, Artificial Sequence
  Description of Artificial Sequence: Synthetic peptide
  XENP20269 vhCDR2
MIWIDGSTDYNSALKS

SEQ ID NO: 30334 - protein, 10 aa, Artificial Sequence
  Description of Artificial Sequence: Synthetic peptide
  XENP20269 vhCDR3
DRPDGRAMDY

SEQ ID NO: 30335 - protein, 106 aa, Artificial Sequence; identical to SEQ ID NO: 25617
  Description of Artificial Sequence: Synthetic polypeptide
  VL of XENP20269

SEQ ID NO: 30336 - protein, 11 aa, Artificial Sequence
  Description of Artificial Sequence: Synthetic peptide
  XENP20269 vlCDR1
KASQSVSNDVA

SEQ ID NO: 30337 - protein, 7 aa, Artificial Sequence
  Description of Artificial Sequence: Synthetic peptide
  XENP20269 vlCDR2
YASNRYT

SEQ ID NO: 30338 - protein, 8 aa, Artificial Sequence
  Description of Artificial Sequence: Synthetic peptide
  XENP20269 vlCDR3
QQDYSSPT

SEQ ID NO: 30339 - protein, 118 aa, Artificial Sequence; identical to SEQ ID NO: 3146
  Description of Artificial Sequence: Synthetic polypeptide
  VH of XENP20872

SEQ ID NO: 30340 - protein, 5 aa, Artificial Sequence
  Description of Artificial Sequence: Synthetic peptide
  XENP20872 vhCDR1
GYGVN

SEQ ID NO: 30341 - protein, 16 aa, Artificial Sequence
  Description of Artificial Sequence: Synthetic peptide
  XENP20872 vhCDR2
MIWIDGSTDYNSKFQG

SEQ ID NO: 30342 - protein, 10 aa, Artificial Sequence
  Description of Artificial Sequence: Synthetic peptide
  XENP20872 vhCDR3
DRPDGRAMDY

SEQ ID NO: 30343 - protein, 106 aa, Artificial Sequence; identical to SEQ ID NO: 3161
  Description of Artificial Sequence: Synthetic polypeptide
  VL of XENP20872

SEQ ID NO: 30344 - protein, 11 aa, Artificial Sequence
  Description of Artificial Sequence: Synthetic peptide
  XENP20872 vlCDR1
KASQSVSNDVA

SEQ ID NO: 30345 - protein, 7 aa, Artificial Sequence
  Description of Artificial Sequence: Synthetic peptide
  XENP20872 vlCDR2
YASNRYT

SEQ ID NO: 30346 - protein, 8 aa, Artificial Sequence
  Description of Artificial Sequence: Synthetic peptide
  XENP20872 vlCDR3
QQDYSSPT

SEQ ID NO: 30347 - protein, 118 aa, Artificial Sequence; identical to SEQ ID NO: 25981
  Description of Artificial Sequence: Synthetic polypeptide
  VH of XENP020882

SEQ ID NO: 30348 - protein, 5 aa, Artificial Sequence
  Description of Artificial Sequence: Synthetic peptide
  XENP020882 vhCDR1
GYGVN

SEQ ID NO: 30349 - protein, 16 aa, Artificial Sequence
  Description of Artificial Sequence: Synthetic peptide
  XENP020882 vhCDR2
MIWIDGSTDYNSKFQG

SEQ ID NO: 30350 - protein, 10 aa, Artificial Sequence
  Description of Artificial Sequence: Synthetic peptide
  XENP020882 vhCDR3
DRPDGRAMDY

SEQ ID NO: 30351 - protein, 106 aa, Artificial Sequence; identical to SEQ ID NO: 3161
  Description of Artificial Sequence: Synthetic polypeptide
  VL of XENP020882

SEQ ID NO: 30352 - protein, 11 aa, Artificial Sequence
  Description of Artificial Sequence: Synthetic peptide
  XENP020882 vlCDR1
KASQSVSNDVA

SEQ ID NO: 30353 - protein, 7 aa, Artificial Sequence
  Description of Artificial Sequence: Synthetic peptide
  XENP020882 vlCDR2
YASNRYT

SEQ ID NO: 30354 - protein, 8 aa, Artificial Sequence
  Description of Artificial Sequence: Synthetic peptide
  XENP020882 vlCDR3
QQDYSSPT

SEQ ID NO: 30355 - protein, 454 aa, Artificial Sequence; identical to SEQ ID NO: 26362
  Description of Artificial Sequence: Synthetic polypeptide
  XENP022917 [ICOS]_H0_L0.38_Fab-1G6_L1.194_H1.279 Fab-Fc Heavy Chain

SEQ ID NO: 30356 - protein, 480 aa, Artificial Sequence; identical to SEQ ID NO: 2930
  Description of Artificial Sequence: Synthetic polypeptide
  XENP022917 [ICOS]_H0_L0.38_Fab-1G6_L1.194_H1.279 scFv-Fc Heavy Chain

SEQ ID NO: 30357 - protein, 214 aa, Artificial Sequence; identical to SEQ ID NO: 26557
  Description of Artificial Sequence: Synthetic polypeptide
  XENP022917 [ICOS]_H0_L0.38_Fab-1G6_L1.194_H1.279 Light Chain

SEQ ID NO: 30358 - protein, 454 aa, Artificial Sequence; identical to SEQ ID NO: 26362
  Description of Artificial Sequence: Synthetic polypeptide
  XENP022977 [ICOS]_H0_L0.37_Fab-1G6_L1.194_H1.279 Fab-Fc Heavy Chain

SEQ ID NO: 30359 - protein, 480 aa, Artificial Sequence; identical to SEQ ID NO: 2930
  Description of Artificial Sequence: Synthetic polypeptide
  XENP022977 [ICOS]_H0_L0.37_Fab-1G6_L1.194_H1.279 scFv-Fc Heavy Chain

SEQ ID NO: 30360 - protein, 214 aa, Artificial Sequence; identical to SEQ ID NO: 26537
  Description of Artificial Sequence: Synthetic polypeptide
  XENP022977 [ICOS]_H0_L0.37_Fab-1G6_L1.194_H1.279 Light Chain

SEQ ID NO: 30361 - protein, 454 aa, Artificial Sequence; identical to SEQ ID NO: 26642
  Description of Artificial Sequence: Synthetic polypeptide
  XENP024901[ICOS]_H0.66_L0_Fab_IgG1_PVA_/S267K_pI(-)_Isosteric _A_L368D/K370S/M428L/N434S Fab-Fc Heavy Chain

SEQ ID NO: 30362 - protein, 231 aa, Artificial Sequence; identical to SEQ ID NO: 2409
  Description of Artificial Sequence: Synthetic polypeptide
  XENP024901 empty_Fc(216)_IgG1_C220S/S364K/E357Q/M428L/N434S empty-Fc Heavy Chain

SEQ ID NO: 30363 - protein, 214 aa, Artificial Sequence; identical to SEQ ID NO: 26297
  Description of Artificial Sequence: Synthetic polypeptide
  XENP024901[ICOS]_ L0 Light Chain

SEQ ID NO: 30364 - protein, 452 aa, Artificial Sequence
  Description of Artificial Sequence: Synthetic polypeptide
  XENP016470 huPD-L1_Fc(216)_huIgG1-mIgG2aa_Hinge(KasI)_mIgG2aa _CH2_CH3
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNEREPKSSDKTHTCPPCPAPNLLGGPSVFIFPPKIKDVLMISLSPMVTCVVVDVSEDDPDVQISWFVNNVEVLTAQTQTHREDYNSTLRVVSALPIQHQDWMSGKEFKCKVNNKALPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 30365 - protein, 433 aa, Artificial Sequence
  Description of Artificial Sequence: Synthetic polypeptide
  XENP017869 huPD-L2_Fc(216)_huIgG1-mIgG2aa_Hinge(KasI)_mIgG2aa _CH2_CH3
LFTVTVPKELYIIEHGSNVTLECNFDTGSHVNLGAITASLQKVENDTSPHRERATLLEEQLPLGKASFHIPQVQVRDEGQYQCIIIYGVAWDYKYLTLKVKASYRKINTHILKVPETDEVELTCQATGYPLAEVSWPNVSVPANTSHSRTPEGLYQVTSVLRLKPPPGRNFSCVFWNTHVRELTLASIDLQSQMEPRTHPTEPKSSDKTHTCPPCPAPNLLGGPSVFIFPPKIKDVLMISLSPMVTCVVVDVSEDDPDVQISWFVNNVEVLTAQTQTHREDYNSTLRVVSALPIQHQDWMSGKEFKCKVNNKALPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 30366 - protein, 469 aa, Artificial Sequence
  Description of Artificial Sequence: Synthetic polypeptide
  XENP023642 huICOSL_Fc(216)_IgG1_C220S/PVA_/S267K
DTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30367 - protein, 231 aa, Artificial Sequence
  Description of Artificial Sequence: Synthetic polypeptide
  XENP021622 empty-Fc(216)_pI(-)_Isosteric_A_C220S/PVA_/S267K/ L368D/K370S/M428L/N434S empty-Fc Heavy Chain
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 30368 - protein, 480 aa, Artificial Sequence; identical to SEQ ID NO: 2930
  Description of Artificial Sequence: Synthetic polypeptide
  XENP021622 1G6_L1.194_H1.279_scFv(GKPGS)4_IgG1_C220S/PVA_/S267K /S364K/E357Q/M428L/N434S scFv-Fc Heavy Chain

SEQ ID NO: 30369 - protein, 447 aa, Artificial Sequence
  Description of Artificial Sequence: Synthetic polypeptide
  XENP016433 Ipilimumab_H0L0_IgG1_PVA_/S267K Heavy Chain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30370 - protein, 215 aa, Artificial Sequence; identical to SEQ ID NO: 7600
  Description of Artificial Sequence: Synthetic polypeptide
  XENP016433 Ipilimumab_H0L0_IgG1_PVA_/S267K Light Chain

SEQ ID NO: 30371 - protein, 447 aa, Artificial Sequence
  Description of Artificial Sequence: Synthetic polypeptide
  XENP020053 [alphaCTLA-4]_H3L0.22-1G6_L1.194_H1.279 Fab-Fc Heavy Chain
EVQLVESGGGLVKPGGSLRLSCAASGFTFSSYTMHWVRQAPGKGLEWVSFISYDGNNKYYADSVKGRFTISRDNAKNSLYLQMNSLRAEDTAVYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 30372 - protein, 480 aa, Artificial Sequence; identical to SEQ ID NO: 2870
  Description of Artificial Sequence: Synthetic polypeptide
  XENP020053 [alphaCTLA-4]_H3L0.22-1G6_L1.194_H1.279 scFv-Fc Heavy Chain

SEQ ID NO: 30373 - protein, 215 aa, Artificial Sequence; identical to SEQ ID NO: 2410
  Description of Artificial Sequence: Synthetic polypeptide
  XENP020053 [alphaCTLA-4]_H3L0.22-1G6_L1.194_H1.279 Light Chain

SEQ ID NO: 30374 - protein, 447 aa, Artificial Sequence; identical to SEQ ID NO: 27506
  Description of Artificial Sequence: Synthetic polypeptide
  XENP29154_TGN1412_hu5.11A1[CD28]_H1_IgG4_K447del Heavy Chain

SEQ ID NO: 30375 - protein, 214 aa, Artificial Sequence; identical to SEQ ID NO: 27132
  Description of Artificial Sequence: Synthetic polypeptide
  XENP29154 TGN1412_hu5.11A1[CD28]_ L1 Light Chain

SEQ ID NO: 30376 - protein, 447 aa, Artificial Sequence
  Description of Artificial Sequence: Synthetic polypeptide
  XENP23058 Jounce_37A10S713_[ICOS]_H0L0_IgG1_WT Heavy Chain
EVQLVESGGGLVQPGGSLRLSCAASGFTFSDYWMDWVRQAPGKGLVWVSNIDEDGSITEYSPFVKGRFTISRDNAKNTLYLQMNSLRAEDTAVYYCTRWGRFGFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30377 - protein, 218 aa, Artificial Sequence; identical to SEQ ID NO: 26357
  Description of Artificial Sequence: Synthetic polypeptide
  XENP23058 Jounce_37A10S713_[ICOS]_H0L0_IgG1_WT Light Chain

SEQ ID NO: 30378 - protein, 446 aa, Artificial Sequence; identical to SEQ ID NO: 26352
  Description of Artificial Sequence: Synthetic polypeptide
  XENP23057 Jounce_37A10S713_[ICOS]_H0L0_IgG1_PVA_/S267K Heavy Chain

SEQ ID NO: 30379 - protein, 218 aa, Artificial Sequence; identical to SEQ ID NO: 26357
  Description of Artificial Sequence: Synthetic polypeptide
  XENP23057 Jounce_37A10S713_[ICOS]_H0L0_IgG1_PVA_/S267K Light Chain

SEQ ID NO: 30380 - protein, 4 aa, Artificial Sequence
  Description of Artificial Sequence: Synthetic peptide
ASTK

SEQ ID NO: 30381 - protein, 4 aa, Artificial Sequence
  Description of Artificial Sequence: Synthetic peptide
RTVA

SEQ ID NO: 30382 - protein, 5 aa, Artificial Sequence
  Description of Artificial Sequence: Synthetic peptide
GSGGS

SEQ ID NO: 30383 - protein, 5 aa, Artificial Sequence
  Description of Artificial Sequence: Synthetic peptide
GGGGS

SEQ ID NO: 30384 - protein, 4 aa, Artificial Sequence
  Description of Artificial Sequence: Synthetic peptide
GGGS

SEQ ID NO: 30385 - protein, 249 aa, Artificial Sequence; identical to SEQ ID NO: 16069
  Description of Artificial Sequence: Synthetic polypeptide
  XENP023104 scFv chain
